US012807940B2

(12) United States Patent
Mali et al.

(10) Patent No.: US 12,807,940 B2
(45) Date of Patent: Nov. 24, 2026

(54) GENE FRAGMENT OVEREXPRESSION SCREENING METHODOLOGIES, AND USES THEREOF

(71) Applicant: The Regents of the University of California, Oakland, CA (US)

(72) Inventors: Prashant Mali, La Jolla, CA (US); Kyle M. Ford, La Jolla, CA (US); Nathan Palmer, La Jolla, CA (US); Rebecca Panwala, La Jolla, CA (US)

(73) Assignee: The Regents of the University of California, Oakland, CA (US)

( * ) Notice: Subject to any disclaimer, the term of this patent is extended or adjusted under 35 U.S.C. 154(b) by 895 days.

(21) Appl. No.: 17/638,428

(22) PCT Filed: Aug. 28, 2020

(86) PCT No.: PCT/US2020/048594
§ 371 (c)(1),
(2) Date: Feb. 25, 2022

(87) PCT Pub. No.: WO2021/041953
PCT Pub. Date: Mar. 4, 2021

(65) Prior Publication Data

US 2022/0307013 A1 Sep. 29, 2022

Related U.S. Application Data

(60) Provisional application No. 63/030,898, filed on May 27, 2020, provisional application No. 62/980,649, filed on Feb. 24, 2020, provisional application No. 62/894,664, filed on Aug. 30, 2019.

(51) Int. Cl.

| | |
|---|---|
| ***C07K 14/82*** | (2006.01) |
| ***A61P 35/00*** | (2006.01) |
| ***C07K 14/47*** | (2006.01) |
| ***C07K 14/71*** | (2006.01) |
| ***C07K 19/00*** | (2006.01) |
| ***C12N 15/10*** | (2006.01) |
| ***C12N 15/79*** | (2006.01) |
| *A61K 38/00* | (2006.01) |

(52) U.S. Cl.
CPC ...... *C12N 15/1079* (2013.01); *C07K 14/4703* (2013.01); *C07K 14/71* (2013.01); *C07K 14/82* (2013.01); *A61K 38/00* (2013.01)

(58) Field of Classification Search
CPC ............ C12N 15/1079; C12N 15/1072; C07K 14/4703; C07K 14/71; C07K 14/82; C07K 2319/50; A61K 38/00; A61K 38/1709; A61P 35/00
See application file for complete search history.

(56) References Cited

U.S. PATENT DOCUMENTS

| | | | | |
|---|---|---|---|---|
| 5,736,337 | A * | 4/1998 | Avruch | A61P 3/08 435/7.1 |
| 2003/0170751 | A1 | 9/2003 | Sherman et al. | |
| 2010/0144636 | A1 | 6/2010 | Pincus et al. | |
| 2015/0299278 | A1 | 10/2015 | Orrichio et al. | |
| 2016/0122415 | A1 | 5/2016 | Soucek et al. | |
| 2017/0067122 | A1* | 3/2017 | Langland | A61P 35/00 |

FOREIGN PATENT DOCUMENTS

| | | | |
|---|---|---|---|
| WO | 2017/173321 | A1 | 10/2017 |
| WO | 2018/227286 | A1 | 12/2018 |

OTHER PUBLICATIONS

Human RAF1 UniProtKB Accession No. P04049, accessed Mar. 20, 2025 at URL: uniprot.org/uniprot/P04049 (Year: 2025).*
De Rooij et al, "Minimal Ras-binding domain of Raf1 can be used as an activation-specific probe for Ras," Oncogene 14:623-625 (1997) (Year: 1997).*
Chuang et al, "Critical Binding and Regulatory Interactions between Ras and Raf Occur through a Small, Stable N-Terminal Domain of Raf and Specific Ras Effector Residues," (Mol Cell Biol 14:5318-5325 (1994)) (Year: 1994).*
Athuluri-Divakar et al, "A Small Molecule RAS-Mimetic Disrupts RAS Association with Effector Proteins to Block Signaling," Cell 165(3): 643-655 (2016) (Year: 2016).*
Chu et al., "Towards understanding cell penetration by stapled peptides", Med. Chem. Comm., Oct. 7, 2015, 6, 111-119.
Young, Lee, International Search Report and Written Opinion, PCT/US2020/048594, International Searching Authority, United States Patent and Trademark office, Feb. 5, 2021.
Bidwell et al., "Therapeutic peptides for cancer therapy. Part I—Peptide inhibitors of signal transduction cascades", Expert Opinion on Drug Delivery, Jul. 29, 2009, vol. 6, No. 10, pp. 1033-1047.
Steinheimer, K., Invitation Pursuant to Rule 62a(1) EPC and Rule 63(1) EPC, European Patent Office, Application No. 20857783.3, Aug. 24, 2023.

(Continued)

*Primary Examiner* — Julie Ha
*Assistant Examiner* — Kristina M Hellman
(74) *Attorney, Agent, or Firm* — Gavrilovich, Dodd & Lindsey LLP

(57) ABSTRACT

Screening methodologies using gene fragment overexpression that provide for the identification of peptide sequences which can modulate the functional regions of proteins of interests, and uses thereof are described. Peptides, polypeptides and polynucleotides identified by the methods of the disclosure, compositions containing such peptides, polypeptides and polynucleotides and uses thereof are also described.

7 Claims, 31 Drawing Sheets

Specification includes a Sequence Listing.

(56) References Cited

OTHER PUBLICATIONS

Lee, Sun Hwa, International Preliminary Report on Patentability and Written Opinion, PCT/US2020/048594, International Bureau of WIPO, Mar. 10, 2022.

Steinheimer, K., Extended European Search Report, European Patent Office, Application No. 20857783.3, Jan. 11, 2024.

* cited by examiner

| **Control** | **Apoptosis** | **Cell cycle** | **Chromatin Histone Modifiers** | **Genome Integrity** | **MAPK Signaling** | **Metabolism** | **NOTCH Signaling** | **Other Signaling** |
|---|---|---|---|---|---|---|---|---|
| HPRT1<br>GFP | CASP8 | CCND1<br>CDKN2A<br>RB1 | NCOA3 | CHEK2<br>MDM2<br>MDM4<br>TERT<br>TP53 | ARA<br>BRAF<br>HRAS<br>KRAS<br>MAP2K1<br>NRAS<br>RAB25<br>RAF1<br>RRAS2 | IDH1<br>IDH2 | NOTCH1 | AR<br>CDH1<br>GNA11<br>GNAQ<br>KEAP1<br>PTPN11<br>RAC1<br>RHOA |
| **PI3K Signaling** | **Protein Homeostasis** | **RNA Abundance** | **RTK Signaling** | **Splicing** | **TGFB Signaling** | **TOR Signaling** | **Transcription Factor** | **Wnt/B-Catenin Signaling** |
| AKT1<br>PIK3CA<br>PIK3R1<br>PPP2R1A | FBXW7<br>SKP2<br>VHL | DDX3X<br>DICER1 | EGRF<br>ERBB2<br>ERBB3<br>ERBB4<br>FGFR2<br>FGFR3<br>FLT3<br>KIT<br>MET<br>RASA1 | SF381 | SMAD2<br>SMAD4<br>TGFBR2 | MTOR<br>RHEB | MAX<br>MYC<br>MYCL<br>MYCN<br>NFE2L2<br>NKX2-98<br>RUNX1<br>YAP1 | CTNNB1 |

FIG. 6A

| Genes | # of Mutants | Genes | # of Mutants | Genes | # of Mutants |
|---|---|---|---|---|---|
| HPRT1 | NA | NOTCH1 | 3 | EGFR | 19 |
| GFP | NA | Other Signaling | | ERBB2 | 3 |
| Apoptosis | | CDH1 | 4 | ERBB3 | 3 |
| CASP8 | 3 | GNA11 | 4 | ERBB4 | 3 |
| Cell Cycle | | GNAQ | 4 | FGFR2 | 3 |
| CDKN2A | 3 | KEAP1 | 9 | FGFR3 | 2 |
| RB1 | 1 | PTPN11 | 15 | FLT3 | 2 |
| Chromatin Histone Modifiers | | RAC1 | 8 | KIT | 9 |
| EP300 | 8 | RHOA | 16 | MET | 4 |
| KMT2C | 2 | PI3K Signaling | | RASA1 | 1 |
| SETD2 | 5 | AKT1 | 3 | Splicing | |
| Genome Integrity | | PIK3CA | 12 | SF3B1 | 16 |
| CHEK2 | 6 | PIK3R1 | 11 | TGFB Signaling | |
| TP53 | 195 | PPP2R1A | 13 | SMAD2 | 2 |
| MAPK Signaling | | Protein Homeostasis | | SMAD4 | 31 |
| BRAF | 16 | FBXW7 | 13 | TGFBR2 | 3 |
| HRAS | 11 | VHL | 24 | TOR Signaling | |
| KRAS | 16 | SPOP | 2 | MTOR | 9 |
| MAP2K1 | 4 | RNA Abundance | | RHEB | 1 |
| NRAS | 9 | DDX3X | 3 | Transcription Factor | |
| RRAS2 | 2 | DICER1 | 9 | NFE2L2 | 9 |
| Metabolism | | ZFP36L2 | 1 | RUNX1 | 2 |
| IDH1 | 2 | | | Wnt/B-Catenin Signaling | |
| IDH2 | 5 | | | CTNNB1 | 15 |

*FIG. 6E*

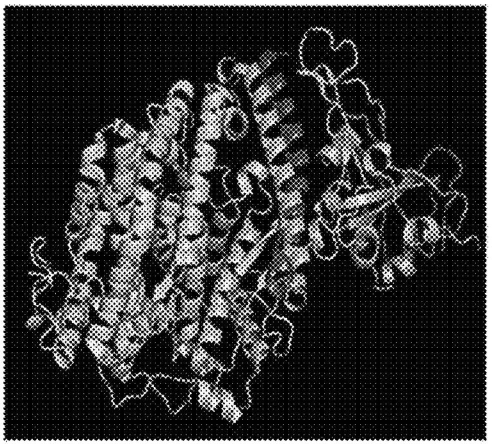

SARS-CoV-2 – ACE2 binding interface

ACE2 – RBD
Green: ACE2
Cyan: SARS-CoV2 RBD
Red: Candidate peptide 1
Orange: Candidate peptide 2

| | |
|---|---|
| ACE2: | MSSSSWLLL------SL------VTAAQSTIEEQAKTFLDK----------------FNHEAEDLFYQSS--------------LASWNYNTNI |
| ACE1 (iso1): | VLGWPEY------QWHFPLPDNYPEGIDLVTDEAEASKFVEE----------------YDRTSQVVWNEYA--------------EANWNYNTNI |
| ACE1 (iso2): | TTSSQTT------THQATAHQTSAQSPNLVTDEAEASKFVEE----------------YDRTSQVVWNEYA--------------EANWNYNTNI |
| DPP9: | VTVWMAYDTGYTERYMDVPENNQH-GYEAGSVALHVEKLPNE----------------PNRL-LILHGFL--------------DENVHFFHTN |
| DPP8: | VTLWIFYDTGYTERYMGHPDQNEQ-GYYLGSVAMQAEKFPSE----------------PNRL-LLLHGFL--------------DENVHFAHTS |
| ANPEP: | -NVTGYYRVNYDEENWRKIQTQLQRDHS-AIPVINRAQIIN------------------------------------DAFNLASAH |
| FAP: | VSSWEYYASVYTERFMGLPTKDDNLEHYKNSTVMARAEYFR----------------NVDY-LLIHGTA--------------DDNVHFQNSA |
| DPP4: | VSRWEYYDSVYTERYMGLPTPEDNLDHYRNSTVMSRAENFK----------------QVEY-LLIHGTA--------------DDNVHFQQSA |
| Fibronectin: | GSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANP |

| | |
|---|---|
| ACE2: | TEENVQNMNNAGD--------------------KW---SAFLKEQSTLAQ----MY-PLQEIQNLTVKLQLQALQQNGSSVLSEDK |
| ACE1: | TTETSKILLQKNM--------------------QI---ANHTLKYGTQAR----KF--DVNQLQNTTIKRIIKKVQDLERAALPAQE |
| DPP9: | F-LVSQLIRAGKPYQLQIYPNERHSIRCP-----ESGEHYEVTLLHFLQEYL------------------------------ |
| DPP8: | I-LLSFLVRAGKPYDLQIYPQERHSIRVP-----ESGEHYELHLLHYLQENLGSRIAAL-----KVI------------------ |
| ANPEP: | KVPVTLALINNTLFLIEERQYMPWEAALSSLSYFKLMFDRSEVYGPMKNYLKKQVTPL--F-------IHFRN---------NTNNWREIPEN- |
| FAP: | Q-IAKALVNAQVDFQAMWYSDQNHGLSGL------STNHLYTHMTHFLKQCFSLSD------------------------------ |
| DPP4: | Q-ISKALVDVGVDFQAMWYTDEDHGIASS------TAHQHIYTHMSHFIKQCFSLP------------------------------ |
| Fibronectin: | QSSCTFDNLSPGLEYNVSVYTVKDDKESVP------------ISD------------TIIPA--------------------- |

*FIG. 8C*

GENE FRAGMENT OVEREXPRESSION SCREENING METHODOLOGIES, AND USES THEREOF

CROSS REFERENCE TO RELATED APPLICATIONS

This application is a U.S. National Stage Application filed under 35 U.S.C. § 371 and claims priority to International Application No. PCT/US2020/048594, filed Aug. 28, 2020, which application claims priority of under 35 U.S.C. § 119 from Provisional Application Ser. No. 62/894,664, filed Aug. 30, 2019; Provisional Application Ser. No. 62/980,649, filed Feb. 24, 2020; and Provisional Application Ser. No. 63/030,898, filed May 27, 2020; the disclosures of each of which are incorporated herein by reference in their entirety.

STATEMENT REGARDING FEDERALLY SPONSORED RESEARCH

This invention was made with government support under CA222826, GM123313, and HG009285 awarded by the National Institutes of Health and under DGE1650112 awarded by the National Science Foundation. The government has certain rights in the invention.

TECHNICAL FIELD

The disclosure provides for screening methodologies using gene fragment overexpression that provide for the identification of peptide sequences which can modulate the functional regions of proteins of interests, and uses thereof. The disclosure further provides peptides and methods use for inhibiting oncoproteins and infectious agents.

INCORPORATION BY REFERENCE OF SEQUENCE LISTING

Accompanying this filing is a Sequence Listing entitled, "Sequence-listing ST25" created on Jun. 24, 2025 and having 6,309,988 bytes of data, machine formatted on IBM-PC, MS-Windows operating system. The sequence listing is hereby incorporated by reference in its entirety for all purposes.

BACKGROUND

Genetic screening has rapidly become a ubiquitous tool to probe protein function and accelerate drug discovery. Libraries of genetically encoded perturbations (CRISPR-Cas9 sgRNA, siRNA, etc.) enable high throughput identification of proteins essential to cancer cells fitness and infectious organisms. However, existing screens typically fail to capture how proteins function biologically and provide little information on how to target hits therapeutically. Transposon mediated fragmentation and overexpression of cDNA has been used to identify peptide inhibitors of essential proteins in *Saccharomyces cerevisiae*. However, these libraries randomly generate gene fragments of various lengths hindering control of library composition, feature many out of frame fragments, and are limited in their translational relevance due to the choice of model organism.

SUMMARY

Disclosed herein are pharmaceutical compositions in unit dose form comprising: (a) a peptide or salt thereof; and (b)

at least one of a pharmaceutically acceptable: excipient, diluent, or carrier. In some embodiments, a peptide or salt thereof can have at least about 80% sequence identity to a polypeptide of any one of SEQ ID NO: 1-9489. In some embodiments, a peptide or salt thereof (i) can modulate an expression level of a target protein implicated in a disease or condition, as measured by an at least partial increase or an at least partial decrease of a level of the target protein in an in vitro assay in a cell treated with the peptide or salt thereof as determined by a Western blot relative to a level of the target protein in an otherwise comparable cell not treated with the peptide or salt thereof; (ii) can produce an at least partial increase or an at least partial decrease of an activity of the target protein, as measured by a level of the activity of the target protein in a cell treated with the peptide or salt thereof relative to a level of activity of the target protein in an otherwise comparable cell not treated with the peptide or salt thereof as determined by an in vitro assay; (iii) can produce an at least partial increase or an at least partial decrease of an activity of a protein downstream of the target protein in a cellular pathway in a cell treated with the peptide or salt thereof relative to a level of activity of the protein downstream of the target protein in a cellular pathway in an otherwise comparable cell not treated with the peptide or salt thereof as determined by an in vitro assay; (iv) can kill a cancer cell in an in vitro assay; or (v) any combination of (i-iv). In some embodiments, a peptide or salt thereof can comprise at least about an 80% sequence identity to a polypeptide of SEQ ID NO:9530. In some embodiments, a peptide or salt thereof can comprise at least about an 80% sequence identity to a polypeptide of SEQ ID NO:9522.

In some embodiments, a peptide or salt thereof can comprise at least about an 80% sequence identity to a polypeptide of SEQ ID NO:9521 or SEQ ID NO:9526. In some embodiments, a peptide or salt thereof can comprise at least about an 80% sequence identity to the polypeptide of SEQ ID NO:9531 or SEQ ID NO:9701. In some embodiments, a peptide or salt thereof can modulate an expression level of a target protein implicated in a disease or condition, as measured by an at least partial increase or the at least partial decrease of a level of the target protein in the in vitro assay in a cell treated with the peptide or salt thereof as determined by the Western blot relative to a level of the target protein in the otherwise comparable cell not treated with the peptide or salt thereof. In some embodiments, a target protein can be at least partially encoded by a gene in Table 7, a variant of a gene in Table 7, or a fragment of any of these. In some embodiments, a peptide or salt thereof can produce an at least partial increase or an at least partial decrease of an activity of a target protein, as measured by a level of the activity of the target protein in the cell treated with the peptide or salt thereof relative to a level of activity of the target protein in the otherwise comparable cell not treated with the peptide or salt thereof as determined by the in vitro assay. In some embodiments, a target protein can be at least partially encoded by a gene in Table 7, a variant of a gene in Table 7, or a fragment of any of these. In some embodiments, a target protein can be a kinase or a biologically active fragment thereof. In some embodiments, a target protein can be a phosphatase or a biologically active fragment thereof. In some embodiments, a peptide or salt thereof can produce an at least partial increase or an at least partial decrease of an activity of a protein downstream of a target protein in a cellular pathway in the cell treated with the peptide or salt thereof relative to a level of activity of the protein downstream of the target protein in the cellular pathway in an otherwise comparable cell not treated with the peptide or salt thereof as determined by an in vitro assay. In some embodiments, a target protein can be at least partially encoded by a gene in Table 7, a variant of a gene in Table 7, or a fragment of any of these. In some embodiments, a target protein can comprise a protein at least partially encoded by a gene in Table 7, a variant of a gene in Table 7, or a fragment of any of these. In some embodiments, a peptide of salt thereof can kill a cancer cell in an in vitro assay. In some embodiments, a peptide or salt thereof can modulate a target protein by at least partially inhibiting a protein to protein interaction. In some embodiments, a protein to protein interaction can comprise a ligand to receptor interaction. In some embodiments, a protein to protein interaction can comprise a regulatory protein complex. In some embodiments, a peptide or salt thereof can at least partially reduce a protein to nucleic acid interaction. In some embodiments, a peptide can comprise independently Gly, or an amino acid comprising a $C_1$-$C_{10}$ alkyl, a $C_1$-$C_{10}$ alkenyl, a $C_1$-$C_{10}$ alkynyl, a cycloalkyl, or an alkylcycloalkyl side chain. In some embodiments, a peptide can comprise an amino acid comprising an aromatic side chain. In some embodiments, a peptide can comprise an amino acid comprising a side chain that can be at least partially protonated at a pH of about 7.3. In some embodiments, a peptide can comprise an amino acid comprising an amide containing side chain. In some embodiments, a peptide can comprise an amino acid comprising an alcohol or thiol containing side chain. In some embodiments, a peptide can comprise an amino acid comprising a side chain that can be at least partially deprotonated at a pH of about 7.3. In some embodiments, a peptide or salt thereof can comprise a recombinant peptide. In some embodiments, at least one amino acid of the peptide or salt thereof can comprise a chemical modification. In some embodiments, a chemical modification can comprise acetylation, sulfonation, amidation, or esterification. In some embodiments, a peptide or salt thereof can comprise a stapled peptide or salt thereof, a stitched peptide or salt thereof, a macrocyclic peptide or salt thereof, or any combination thereof. In some embodiments, peptide or salt thereof can comprise a stapled peptide and the stapled peptide can comprise a covalent linkage between two amino acid side-chains. In some embodiments, a peptide or salt thereof can further comprise a cell penetrating peptide directly or indirectly linked to a peptide or salt thereof. In some embodiments, an amino acid of the peptide or salt thereof positioned at an end terminus can comprise a side chain that can be at least partially deprotonated at a pH of about 7.3.

Also disclosed herein are nucleic acids. In some embodiments, a nucleic acid can at least partially encode a peptide, having at least about 80% sequence identity to a polypeptide of SEQ ID NO:1-9489 or 9701. In some embodiments, the peptide; (i) can modulate an expression level of a target protein implicated in a disease or condition, as measured by an at least partial increase or an at least partial decrease of a level of the target protein in an in vitro assay in a cell treated with the nucleic acid as determined by a Western blot relative to a level of the target protein in an otherwise comparable cell not treated with the nucleic acid; (ii) can produce an at least partial increase or an at least partial decrease of an activity of the target protein, as measured by a level of the activity of the target protein in a cell treated with the nucleic acid relative to a level of activity of the target protein in an otherwise comparable cell not treated with the nucleic acid in as determined by an in vitro assay; (iii) can produce an at least partial increase or an at least partial decrease of an activity of a protein downstream of the target protein in a cellular pathway in a cell treated with the nucleic acid relative to a level of activity of the protein downstream of the target protein in a cellular pathway in an otherwise comparable cell not treated with the nucleic acid as determined by an in vitro assay; (iv) can kill a cancer cell in an in vitro assay; or (v) any combination of (i-iv). In some embodiments, a peptide at least partially encoded by the nucleic acid may not comprise more than about 40 amino acids. In some embodiments, a nucleic acid can be comprised in a pharmaceutical composition in unit dose form. In some embodiments, a peptide at least partially encoded by the nucleic acid can comprise independently Gly, or an amino acid comprising a $C_1$-$C_{10}$ alkyl, a $C_1$-$C_{10}$ alkenyl, a C1-C10 alkynyl, a cycloalkyl, or an alkylcycloalkyl side chain. In some embodiments, a peptide at least partially encoded by a nucleic acid can comprise an amino acid comprising an aromatic side chain. In some embodiments, a peptide at least partially encoded by a nucleic acid can comprise an amino acid comprising a side chain that can be at least partially protonated at a pH of about 7.3. In some embodiments, a peptide at least partially encoded by a nucleic acid can comprise an amino acid comprising an amide containing side chain. In some embodiments, a peptide at least partially encoded by a nucleic acid can comprise an amino acid comprising an alcohol or thiol containing side chain. In some embodiments, a peptide at least partially encoded by a nucleic acid can comprise an amino acid comprising a side chain that can be at least partially deprotonated at a pH of about 7.3. In some embodiments, a nucleic acid can be double stranded. In some embodiments, a nucleic acid can comprise DNA, RNA or any combination thereof.

Also disclosed herein are vectors that comprise a nucleic acid of the disclosure. In some embodiments, a vector can comprise a polypeptide coat. In some embodiments, a vector can comprise a nanoparticle, a microparticle, a viral vector, a virus-like particle, a liposome, or any combination thereof. In some embodiments, a vector can comprise a viral vector, and the viral vector can comprise an AAV vector. In some embodiments, an AAV vector can be selected from the group consisting of: AAV1, AAV2, AAV3, AAV4, AAV5, AAV6, AAV7, AAV8, AAV9, AAV10, AAV11, AAV12, AAVDJ, and variants thereof. In some embodiments, the vector can be a gamma-retroviral vector.

Also disclosed herein are isolated peptides or salt thereof comprising a sequence having at least about 80% sequence homology to any one of the peptides of SEQ ID NO: 1-9489 or 9701.

Also disclosed herein is a kit that comprises a pharmaceutical composition, a nucleic acid, a vector, an isolated peptide or salt thereof; and a container.

Provided herein is a method of at least partially treating or preventing a disease or condition in a subject. In some cases, the method comprises administering a therapeutically effective amount of a pharmaceutical composition, a nucleic acid, a vector, or an isolated peptide or salt thereof; to a subject to at least partially prevent or treat the disease or condition. In some cases, a method comprises at least partially treating a subject. In some cases, at least partially treating comprises ameliorating at least one symptom of a disease or condition. In some cases, a method comprises at least partially treating. In some cases, at least partially treating comprises reducing a growth of a tumor. In some cases, a method comprises at least partially treating. In some cases, at least partially treating comprises at least partially eliminating a tumor. In some cases, a disease or condition comprises a cancer. In some cases, a cancer comprises a sarcoma, a carcinoma, a melanoma, a lymphoma, a leukemia, a blastoma, a germ cell tumor, a myeloma, or any combination thereof. In some cases, prior to treating a subject, the subject has been diagnosed with cancer.

In some cases, a method provided herein can further comprise diagnosing a subject with cancer. In some cases, diagnosing comprises diagnosing with a physical examination, a biopsy, a radiological image, a blood test, a urine test, an antibody test, or any combination thereof. In some cases, diagnosing comprises radiological imagine. In some cases, radiological imaging comprises a computed tomography (CT) image, a nuclear scan, an X-Ray image, a magnetic resonance image (MRI), an ultrasound image, or any combination thereof. In some cases, administering can be intra-arterial, intravenous, intramuscular, oral, topical, intranasal, subcutaneous, inhalation, catheterization, gastrostomy tube administration, intraosseous, ocular, otic, transdermal, rectal, nasal, intravaginal, intracavernous, transurethral, sublingual, or any combination thereof. In some cases, administering can be performed at least about: 1 time per day, 2 times per day, 3 times per day, or 4 times per day. In some cases, administering can be performed for about: 1 day to about 7 days, 1 week to about 5 weeks, 1 month to about 12 months, 1 year to about 3 years, 3 years to about 8 years, or 8 years to about 20 years. In some cases, a method further comprises administering a therapeutically effective amount of a second therapy to a subject. In some cases, a second therapy comprises surgery, chemotherapy, radiation therapy, immunotherapy, hormone therapy, a checkpoint inhibitor, targeted drug therapy, a gene editing therapy, an RNA editing therapy, a protein knockdown therapy, chimeric antigen receptor (CAR) T-cell therapy, or a combination thereof.

In some cases, a subject is a human. In some cases, a human is from about 1 day to about 1 month old, from about 1 month to about 12 months old, from about 1 year to about 7 years old, from about 5 years to about 25 years old, from about 20 years to about 50 years old, from about 45 years to about 80 years old, or from about 75 years to about 130 years old.

Provided herein is a method of making a pharmaceutical composition. In some cases, a method comprises contacting a peptide or salt thereof with a pharmaceutically acceptable excipient, diluent or carrier.

Provided herein is a method of at least partially reducing or at least partially increasing activity of a target protein comprising: (a) expressing a fragment of a gene in a target cell, wherein the gene fragment is expressed from a polynucleotide, wherein the gene fragment comprises at least a portion of the target protein and wherein the gene fragment is from about 60 nucleotides to about 150 nucleotides in length; and (b) measuring the at least partial reduction or the at least partial increase of activity by determining a change of a level of activity of the target protein in a cell treated with the polynucleotide relative to a level of activity of the target protein in an otherwise comparable cell not treated with the polynucleotide an in vitro assay; wherein the target protein is selected from a protein at least partially encoded by a gene or a variant thereof recited in Table 7.

Provided herein is a method of at least partially reducing or at least partially increasing activity of a protein downstream of a target protein in a cellular pathway comprising: (a) expressing a fragment of a gene in a target cell, wherein the gene fragment is expressed from a polynucleotide, wherein the gene fragment comprises at least a portion of the target protein and wherein the gene fragment is from about 60 nucleotides to about 150 nucleotides in length; and (b) measuring the at least partial reduction or the at least partial increase of activity by determining a change of a level of activity of the downstream protein of a cell treated with the polynucleotide relative to a level of activity of the downstream protein in an otherwise comparable cell not treated with the polynucleotide in an in vitro assay; wherein the target protein is selected from a protein at least partially encoded by a gene or a variant thereof recited in Table 7. In some cases, a fragment of a gene encodes for a peptide comprising a sequence having at least about 80% sequence homology to any one of the peptides of SEQ ID NO: 1-9489 or 9701. In some cases, a polynucleotide is comprised in a plasmid. In some cases, a polynucleotide or a plasmid can be transfected into a target cell. In some cases, at least a portion of a target protein comprises about 20 amino acids to about 50 amino acids. In some cases, a reduction of activity further comprises reduced cell growth.

Provided herein is a method of screening for at least partially reducing or at least partially increasing activity of a target protein, a protein downstream of a target protein in a cellular pathway, or both comprising: (a) expressing one or more fragments of a gene in a target cell, wherein each gene fragment is expressed from a polynucleotide, wherein the one or more gene fragments comprise at least a portion of the target protein and wherein the gene fragment is from about 60 nucleotides to about 300 nucleotides in length; and (b) measuring the at least partial reduction or the at least partial increase of activity by determining a change of a level of activity of the target protein in a cell treated with the polynucleotide relative to a level of activity of the target protein in an otherwise comparable cell not treated with the polynucleotide in an in vitro assay; wherein the target protein is selected from a protein encoded by a gene or a variant thereof recited in Table 7. In some cases, a fragment of a gene encodes for a peptide comprising a sequence having at least about 80% sequence homology to any one of peptides of SEQ ID Nos: 1-9489. In some cases, a polynucleotide is comprised in a plasmid. In some cases, a polynucleotide or a plasmid is transfected into a target cell. In some cases, at least a portion of a target protein comprises about 20 amino acids to about 50 amino acids.

The disclosure also provides a composition comprising a peptide fragment, wherein the peptide fragment consists of 35-45 amino acids from a protein selected from the group consisting of AKT1, AR, ARAF, BRAF, CASP8, CCND1, CDH1, CDKN2A, CHEK2, CTNNB1, DDX3X, DICER1, EGFR, EP300, ERBB2, ERBB3, ERBB4, FBXW7, FGFR2, FGFR3, FLT3, GFP, GNA11, GNAQ, HPRT1, HRAS, IDH1, IDH2, KEAP1, KIT, KMT2C, KRAS, KRAS4B, MAP2K1, MAX, MDM2, MDM4, MET, MTOR, MYC, MYCL, MYCN, NCOA3, NFE2L2, NKX2, NOTCH1, NRAS, OMOMYC, PIK3CA, PIK3R1, PPP2R1A, PTPN11, RAB25, RAC1, RAF1, RASA1, RB1, RHEB, RHOA, RRAS2, RUNX1, SETD2, SF3B1, SKP2, SMAD2, SMAD4, SPOP, TERT, TGFBR2, TP53, VHL, YAP1, ZFP36L2, ACE1, ACE2, DPP4, DPP8, DPP9, ANPEP, FAP, and Fibronectin, wherein the peptide fragment at least partially inhibits the biological activity of the protein from which it has greater than 98% identity and/or binds to a cognate of the protein. In one embodiment, the peptide fragment is identified by: synthesizing a library of overlapping gene fragments from a gene that expresses the protein, wherein each gene fragment of the library of overlapping gene fragments has a unique nucleotide sequence, wherein each gene fragment has a sequence which partial overlaps with the sequences of least two or more gene fragments having nucleotide sequences from the gene; pooling and cloning the gene fragments into vectors, wherein each vector overexpresses one gene fragment when transduced or transfected into a cell; transfecting or transducing cells with the vectors comprising gene fragments, wherein each transduced or transfected cell has only one vector that comprises a gene fragment; screening the transfected or transduced cells for cell growth over various time points; sequencing and quantifying gene fragment abundance from each of the time points; and mapping the sequenced gene fragments back to the gene that express the target protein and providing a depletion score for each codon, wherein the depletion score is defined as the mean depletion/enrichment of all overlapping sequenced gene fragments, and wherein codons of the gene fragments which have a depletion score below a p=0.05 significance threshold, indicates peptide sequences which inhibit functional regions of the protein expressed by the gene. In another embodiment, the peptide fragment consists essentially of or consists of a sequence of 35-45 amino acids selected from the group consisting of: (a) a sequence of 35-40 amino acids located between amino acid 6 and 466 of SEQ ID NO:9540 and optionally wherein the peptide has a mutation as referenced to SEQ ID NO:9540 of 17K or 52R; (b) a sequence of 35-40 amino acids of SEQ ID NO:9542; (c) a sequence of 35-40 amino acids of SEQ ID NO:9544; (d) a sequence of 35-40 amino acids of SEQ ID NO:9546 and optionally wherein the peptide has a mutation as referenced to SEQ ID NO:9546 of 464V, 466E, 467L, 468C, 469A/R, 568D, 575K, 581I, 594G/N, 596D/S, 597Q/V, and/or 600E; (e) a sequence of 35-40 amino acids of SEQ ID NO:9548 and optionally wherein the peptide has a mutation as referenced to SEQ ID NO:9548 of 363D, and/or 367G; (f) a sequence of 35-40 amino acids of SEQ ID NO:9550; (g) a sequence of 35-40 amino acids of SEQ ID NO:9552 and optionally wherein the peptide has a mutation as referenced to SEQ ID NO:9552 of 222G, 257G/N, and/or 290G; (h) a sequence of 35-40 amino acids of SEQ ID NO:9554 and optionally wherein the peptide has a mutation as referenced to SEQ ID NO:9554 of 118T and/or 84Y; (i) a sequence of 35-40 amino acids of SEQ ID NO:9556 and optionally wherein the peptide has a mutation as referenced to SEQ ID NO:9556 of 381R, 388L/Y, 389H, 415F, and/or 452G; (j) a sequence of 35-40 amino acids of SEQ ID NO:9558 and optionally wherein the peptide has a mutation as referenced to SEQ ID NO:9558 of 32V, 34R, 333F, 334K, 335T, 383C/G, 386G, 387I/K/Y, and/or 426D; (k) a sequence of 35-40 amino acids of SEQ ID NO:9560 and optionally wherein the peptide has a mutation as referenced to SEQ ID NO:9560 of 528C and/or 532A/M; (l) a sequence of 35-40 amino acids of SEQ ID NO:9562 and optionally wherein the peptide has a mutation as referenced to SEQ ID NO:9562 of 1703S, 1705K, 1709N, 1806N, 1809R, 1810Y/V, and/or 1813D/G; (m) a sequence of 35-40 amino acids of SEQ ID NO:9564 and optionally wherein the peptide has a mutation as referenced to SEQ ID NO:9564 of 85M, 108G/K, 252C, 270C, 289T/V, 596R/S, 598V, 628F, 719C/D, 724S, 759N, 836H, 858R, 861Q, and/or 891C; (n) a sequence of 35-40 amino acids of SEQ ID NO:9566 and optionally wherein the peptide has a mutation as referenced to SEQ ID NO:9566 of 1397D, 1398P, 1399N, 1400I, 1414C/D, 1446C, and/or 1451P; (o) a sequence of 35-40 amino acids of SEQ ID NO:9568 and optionally wherein the peptide has a mutation as referenced to SEQ ID NO:9568 of 310F and/or 755M/S; (p) a sequence of 35-40 amino acids of SEQ ID NO:9570 and optionally wherein the peptide has a mutation as referenced to SEQ ID NO:9570 of 103H and/or 232V; (q) a sequence of 35-40 amino acids of SEQ ID NO:9572 and optionally wherein the peptide has a mutation as referenced to SEQ ID NO:9572 of 785R/V; (r) a sequence of 35-40 amino acids of SEQ ID NO:9574 and optionally wherein the peptide has a mutation as referenced to SEQ ID NO:9574 of 426L, 465C/H, 479Q, 502V, 505G/L, 516N/R, 517E/R, 520N, and/or 545C; (s) a sequence of 35-40 amino acids of SEQ ID NO:9576 and optionally wherein the peptide has a mutation as referenced to SEQ ID NO:9576 of 251Q and/or 545Q; (t) a sequence of 35-40 amino acids of SEQ ID NO:9578 and optionally wherein the peptide has a mutation as referenced to SEQ ID NO:9578 of 248C and/or 249C; (u) a sequence of 35-40 amino acids of SEQ ID NO:9580 and optionally wherein the peptide has a mutation as referenced to SEQ ID NO:9580 of 617E and/or 618L; (v) a sequence of 35-40 amino acids of SEQ ID NO:9582; (w) a sequence of 35-40 amino acids of SEQ ID NO:9584 and optionally wherein the peptide has a mutation as referenced to SEQ ID NO:9584 of 183C and/or 209H; (x) a sequence of 35-40 amino acids of SEQ ID NO:9586 and optionally wherein the peptide has a mutation as referenced to SEQ ID NO:9586 of 48V, 209P, and/or 247G; (y) a sequence of 35-40 amino acids of SEQ ID NO:9588; (z) a sequence of 35-40 amino acids of SEQ ID NO:9590 and optionally wherein the peptide has a mutation as referenced to SEQ ID NO:9590 of 12V, 13R/V, 59T, 60S/V, 61K/L, and/or 117N/R; (aa) a sequence of 35-40 amino acids of SEQ ID NO:9592 and optionally wherein the peptide has a mutation as referenced to SEQ ID NO:9592 of 132C/H; (bb) a sequence of 35-40 amino acids of SEQ ID NO:9594 and optionally wherein the peptide has a mutation as referenced to SEQ ID NO:9594 of 137E, 140Q, and/or 172G/K/S; (cc) a sequence of 35-40 amino acids of SEQ ID NO:9596 and optionally wherein the peptide has a mutation as referenced to SEQ ID NO:9596 of 152A, 333D/S, 413H, 477S, 483C, 524C, 525C, and/or 571D; (dd) a sequence of 35-40 amino acids of SEQ ID NO:9598 and optionally wherein the peptide has a mutation as referenced to SEQ ID NO:9598 of 559G, 573Q, 576P, 636V, 637H, 642E, 812V, and/or 816V/Y; (ee) a sequence of 35-40 amino acids of SEQ ID NO:9600 and optionally wherein the peptide has a mutation as referenced to SEQ ID NO:9600 of 370Y and/or 385Y; (ff) a sequence of 35-40 amino acids of SEQ ID NO:9602 and optionally wherein the peptide has a mutation as referenced to SEQ ID NO:9602 of 12R/V, 14I, 19F, 20R, 21R, 34L, 59G/T, 61K/R, 62K, 63K, and/or 117N; (gg) a sequence of 35-40 amino acids of SEQ ID NO:9604; (hh) a sequence of 35-40 amino acids of SEQ ID NO:9606 and optionally wherein the peptide has a mutation as referenced to SEQ ID NO:9606 of 121R, 124L/S and/or 130C; (ii) a sequence of 35-40 amino acids of SEQ ID NO:9608; (jj) a sequence of 35-40 amino acids of SEQ ID NO:9610; (kk) a sequence of 35-40 amino acids of SEQ ID NO:9612; (ll) a sequence of 35-40 amino acids of SEQ ID NO:9614 and optionally wherein the peptide has a mutation as referenced to SEQ ID NO:9614 of 1110I, 1246H, and/or 1248C/H; (mm) a sequence of 35-40 amino acids of SEQ ID NO:9616 and optionally wherein the peptide has a mutation as referenced to SEQ ID NO:9616 of 1977R, 1981E, 2215F, 2230V, and/or 2406A/M; (nn) a sequence of 35-40 amino acids of SEQ ID NO:9618; (oo) a sequence of 35-40 amino acids of SEQ ID NO:9620; (pp) a sequence of 35-40 amino acids of SEQ ID NO:9622; (qq) a sequence of 35-40 amino acids of SEQ ID NO:9624; (rr) a sequence of 35-40 amino acids of SEQ ID NO:9626 and optionally wherein the peptide has a mutation as referenced to SEQ ID NO:9626 of 77G, 79G/Q, 80A/I, 81S/V, and/or 82D/V; (ss) a sequence of 35-40 amino acids of SEQ ID NO:9628; (tt) a sequence of 35-40 amino acids of SEQ ID NO:9630 and optionally wherein the peptide has a mutation as referenced to SEQ ID NO:9630 of 440R and/or 449Y; (uu) a sequence of 35-40 amino acids of SEQ ID NO:9632 and optionally wherein the peptide has a mutation as referenced to SEQ ID NO:9632 of 12D, 13D/R, 16N, 61H/K/R, and/or 62K; (vv) a sequence of 35-40 amino acids of SEQ ID NO:9634; (ww) a sequence of 35-40 amino acids of SEQ ID NO:9636 and optionally wherein the peptide has a mutation as referenced to SEQ ID NO:9636 of 344G/M, 345I/Y, 365V, 420R, 471L, 539R, 545A/K, 546R, and/or 956F; (xx) a sequence of 35-40 amino acids of SEQ ID NO:9638 and optionally wherein the peptide has a mutation as referenced to SEQ ID NO:9638 of 375W, 376R, 379E/N, 557P, 560G/Y, 565R, 567E, and/or 568T; (yy) a sequence of 35-40 amino acids of SEQ ID NO:9640 and optionally wherein the peptide has a mutation as referenced to SEQ ID NO:9640 of 144C, 179R, 182W, 183Q/W, 217K/R, 220M, 256Y, 257C, 258C/H and/or 260G; (zz) a sequence of 35-40 amino acids of SEQ ID NO:9642 and optionally wherein the peptide has a mutation as referenced to SEQ ID NO:9642 of 60V, 71L, 72D, 76A/K, 279C, 282M, 461G/T, 498W, 503V, 504I, 507K, and/or 510H/L; (aaa) a sequence of 35-40 amino acids of SEQ ID NO:9644; (bbb) a sequence of 35-40 amino acids of SEQ ID NO:9646 and optionally wherein the peptide has a mutation as referenced to SEQ ID NO:9646 of 15S, 18Y, 29L/S, 61R, 68H, 135N, 178V; (ccc) a sequence of 35-40 amino acids of SEQ ID NO:9648; (ddd) a sequence of 35-40 amino acids of SEQ ID NO:9650 and optionally wherein the peptide has a mutation as referenced to SEQ ID NO:9650 of 789L; (eee) a sequence of 35-40 amino acids of SEQ ID NO:9652 and optionally wherein the peptide has a mutation as referenced to SEQ ID NO:9652 of 563S; (fff) a sequence of 35-40 amino acids of SEQ ID NO:9654 and optionally wherein the peptide has a mutation as referenced to SEQ ID NO:9654 of 60V; (ggg) a sequence of 35-40 amino acids of SEQ ID NO:9656 and optionally wherein the peptide has a mutation as referenced to SEQ ID NO:9656 of 17A, 22R, 37I, 42C, 47K, 59G/Y, 60K, 61D, 62E/R, 63K, 70S, 73P, and/or 161T/V; (hhh) a sequence of 35-40 amino acids of SEQ ID NO:9658 and optionally wherein the peptide has a mutation as referenced to SEQ ID NO:9658 of 72H/L; (iii) a sequence of 35-40 amino acids of SEQ ID NO:9660 and optionally wherein the peptide has a mutation as referenced to SEQ ID NO:9660 of 107L and/or 110N; (jjj) a sequence of 35-40 amino acids of SEQ ID NO:9662 and optionally wherein the peptide has a mutation as referenced to SEQ ID NO:9662 of 1543Q, 1603R, 1625C/L, and/or 1628T; (kkk) a sequence of 35-40 amino acids of SEQ ID NO:9664 and optionally wherein the peptide has a mutation as referenced to SEQ ID NO:9664 of 622Q, 625C/H, 626Y, 662R, 663P, 666E/N/T, 700E, 741E, 746V, 862K, 902G/K, and/or 903P; (lll) a sequence of 35-40 amino acids of SEQ ID NO:9666; (mmm) a sequence of 35-40 amino acids of SEQ ID NO:9668 and optionally wherein the peptide has a mutation as referenced to SEQ ID NO:9668 of 450E/N; (nnn) a sequence of 35-40 amino acids of SEQ ID NO:9670 and optionally wherein the peptide has a mutation as referenced to SEQ ID NO:9670 of 339L, 351G/H, 352R/V, 353C/N, 355V/Y, 356L/S, 361C/H, 363S, 365D/R, 366K, 368C, 382D, 383R, 384D, 3865/V, 406V, 408L, 504R, 507N, 509G, 523W, and/or 524L/R; (ooo) a sequence of 35-40 amino acids of SEQ ID NO:9672 and optionally wherein the peptide has a mutation as referenced to SEQ ID NO:9672 of 87N and/or 131G; (ppp) a sequence of 35-40 amino acids of SEQ ID NO:9674; (qqq) a sequence of 35-40 amino acids of SEQ ID NO:9676 and optionally wherein the peptide has a mutation as referenced to SEQ ID NO:9676 of 553H; (rrr) a sequence of 35-40 amino acids of SEQ ID NO:9678 and optionally wherein the peptide has a mutation as referenced to SEQ ID NO:9678 of 105C/V, 109S/V, 110P, 111R, 113V, 120E, 121Y, 125M/P, 126D/S, 127P/Y, 130R/V, 131I, 132E/N, 134L, 135R, 136E/H, 137Q, 138T/V, 141R/Y, 143A/M, 144H/P, 145P, 147G, 151S/H, 152L/S, 155P, 156P, 157D, 158S, 159P, 161D/T, 162F/N, 163C/H, 164E, 171K, 172D/F, 173G/L, 176F/R, 177R/S, 178Q, 179D/Q/R, 180K, 181C/H, 190L, 192R, 193N/R, 194F/H, 195F/M/N, 196P, 197G/L, 205N/S, 208G, 211I, 213L, 214R, 215G/I, 216E/L, 218E, 220C/H, 230P, 232S, 234C/H, 236C/H, 237I/K/V, 238R/W/Y, 239D, 240R, 241F/P, 2425/Y, 243I, 244D/S, 245D/S, 246T/V, 247I, 248Q/W, 249G/M/S, 250R, 251F/N, 253A, 254S, 255T, 256I, 257R, 258D/G/K, 259V/Y, 262V, 265P, 266R/V, 267Q/W, 270S/V, 271K/V, 272G/M, 273C/H, 274G/L, 275G/Y, 276G/P, 277G/Y, 278R/S, 279E/R, 280K/S, 281E/H/V, 282Q/W, 283P, 284P, 285K/V, 286G/Q, 332F, 334V/W, 337H/S, and/or 348F/S; (sss) a sequence of 35-40 amino acids of SEQ ID NO:9680 and optionally wherein the peptide has a mutation as referenced to SEQ ID NO:9680 of 79G, 80R, 82P, 89H, 115N, 117C, 118P, 120G, 128H, 130D/F, 131Y, 136V, 151F/N, 153P, 158R/V, 161Q, 162R, 165D, 178P, 184P, and/or 188P; (ttt) a sequence of 35-40 amino acids of SEQ ID NO:9682; (uuu) a sequence of 35-40 amino acids of SEQ ID NO:9684 and optionally wherein the peptide has a mutation as referenced to SEQ ID NO:9684 of 159Y; (vvv) a sequence of 35-40 amino acids of SEQ ID NO:9688; (www) a sequence of 35-40 amino acids of SEQ ID NO:9686; (xxx) a sequence of 35-40 amino acids of SEQ ID NO:9696; (yyy) a sequence of 35-40 amino acids of SEQ ID NO:9700; (zzz) a sequence of 35-40 amino acids of SEQ ID NO:9690; (aaaa) a sequence of 35-40 amino acids of SEQ ID NO:9692; (bbbb) a sequence of 35-40 amino acids of SEQ ID NO:9694; and (cccc) a sequence of 35-40 amino acids of SEQ ID NO:9698. In another embodiment, the peptide of (a) has the sequence selected from the group consisting of SEQ ID NO:1-5, 5000-5009 and 5010. In another embodiment, the peptide of (b) has the sequence selected from the group consisting of SEQ ID NO: 3499, 3750-3759, 5011-5072 and 5073. In another embodiment, the peptide of (c) has the sequence selected from the group consisting of SEQ ID NO: 5074-5083 and 5084. In another embodiment, the peptide of (d) has the sequence selected from the group consisting of SEQ ID NO: 6-15, 350-489, 2555-2586, 2949-2974, 3500-3509, 3760-3792, 5086-5184 and 5185. In another embodiment, the peptide of (e) has the sequence selected from the group consisting of SEQ ID NO: 490-498, 2587-2588, 2975-2981, 3511, 3793-3804, 5186-5227 and 5228. In another embodiment, the peptide of (f) has the sequence selected from the group consisting of SEQ ID NO: 5229-5249 and 5250. In another embodiment, the peptide of (g) has the sequence selected from the group consisting of SEQ ID NO: 499-514, 2589-2591, 2982, 3511, 3805-3816, 5251-5309 and 5310. In another embodiment, the peptide of (h) has the sequence selected from the group consisting of SEQ ID NO: 515-516 and 517. In another embodiment, the peptide of (i) has the sequence selected from the group consisting of SEQ ID NO: 518-592, 2592-2609, 2983-3009, 3443-3444, 3512-3514, 3817-3859, 5311-5449 and 5450. In another embodiment, the peptide of (j) has the sequence selected from the group consisting of SEQ ID NO: 16-27, 593-636, 2610-2629, 3010-3039, 3860-3862, 5451-5501 and 5502. In another embodiment, the peptide of (k) has the sequence selected from the group consisting of SEQ ID NO: 637-645, 2630-2634, 3040-3042, 3863-3878, 5503-5581 and 5582. In another embodiment, the peptide of (l) has the sequence selected from the group consisting of SEQ ID NO: 28-32, 646-671, 2635-2639, 3043-3059, 3445-3447, 3515-3532, 3879-3941, 5583-5862 and 5863. In another embodiment, the peptide of (m) has the sequence selected from the group consisting of SEQ ID NO: 33-49, 672-725, 2640-2655, 3060-3082, 3448, 3533-3536, 3942-3973, 5864-5933 and 5934. In another embodiment, the peptide of (n) has the sequence selected from the group consisting of SEQ ID NO: 50-59, 726-736, 2656-2660, 3083-3104 and 3105. In another embodiment, the peptide of (o) has the sequence selected from the group consisting of SEQ ID NO: 60, 737-742, 2661-2662, 3106-3107, 3537-3538, 3974-3985, 5935-5979 and 5980. In another embodiment, the peptide of (p) has the sequence selected from the group consisting of SEQ ID NO: 743-745, 3539-3544, 3986-3998, 5981-6063 and 6064. In another embodiment, the peptide of (q) has the sequence selected from the group consisting of SEQ ID NO: 746-751, 2663, 3108-3110, 3449-3451, 3545-3548, 3999-4047, 6065-6179 and 6180. In another embodiment, the peptide of (r) has the sequence selected from the group consisting of SEQ ID NO: 752-812, 2664-2668, 3111-3125, 3549, 4048-4061, 6181-6250 and 6251. In another embodiment, the peptide of (s) has the sequence selected from the group consisting of SEQ ID NO: 813-819, 2669-2671, 3126-3130, 4062-4075, 6252-6309 and 6310. In another embodiment, the peptide of (t) has the sequence selected from the group consisting of SEQ ID NO: 820-824, 6311-6322 and 6323. In another embodiment, the peptide of (u) has the sequence selected from the group consisting of SEQ ID NO: 825-855, 2672-2678, 3131, 3550-3572, 4076-4106, 6324-6470 and 6471. In another embodiment, the peptide of (v) has the sequence selected from the group consisting of SEQ ID NO: 856-857 and 858. In another embodiment, the peptide of (w) has the sequence selected from the group consisting of SEQ ID NO: 859-863, 3132, 4107, 6472-6480 and 6481. In another embodiment, the peptide of (x) has the sequence selected from the group consisting of SEQ ID NO: 61-63, 864-866, 2679-2682, 3133-3136, 6482-6509 and 6510. In another embodiment, the peptide of (y) has the sequence selected from the group consisting of SEQ ID NO: 64-65, 867-875, 2683, 3137-3146, 4108, 6511-6524 and 6525. In another embodiment, the peptide of (z) has the sequence selected from the group consisting of SEQ ID NO: 876-894, 2684, 3147-3149, 6526 and 6527. In another embodiment, the peptide of (aa) has the sequence selected from the group consisting of SEQ ID NO: 895-905, 3150-3152, 4109, 6528-6556 and 6557. In another embodiment, the peptide of (bb) has the sequence selected from the group consisting of SEQ ID NO: 66-69, 899-905, 4110-4111, 6558-6570 and 6571. In another embodiment, the peptide of (cc) has the sequence selected from the group consisting of SEQ ID NO: 906-921, 2685, 3153-3156, 4112, 6572-6581 and 6582. In another embodiment, the peptide of (dd) has the sequence selected from the group consisting of SEQ ID NO: 70-73, 922-950, 2686-2703, 3157-3184, 3573-3574, 4113-4127, 6583-6706 and 6707. In another embodiment, the peptide of (ee) has the sequence selected from the group consisting of SEQ ID NO: 951-961, and 3185. In another embodiment, the peptide of (ff) has the sequence selected from the group consisting of SEQ ID NO: 962-1052, 2704-2721, 3186-3198, 3452, 3575-3579, 4128-4158, 6708-6752 and 6753. In another embodiment, the peptide of (gg) has the sequence selected from the group consisting of SEQ ID NO: 4159-4167, 6754-6804 and 6805. In another embodiment, the peptide of (hh) has the sequence selected from the group consisting of SEQ ID NO: 74, 1053-1059, 2722, 3199-3202, 3580, 4168-4180, 6806-6847 and 6848. In another embodiment, the peptide of (ii) has the sequence selected from the group consisting of SEQ ID NO: 6849-6850 and 6851. In another embodiment, the peptide of (jj) has the sequence selected from the group consisting of SEQ ID NO: 3453-3455, 3581-3588, 4181-4221, 6852-6938 and 6939. In another embodiment, the peptide of (kk) has the sequence selected from the group consisting of SEQ ID NO: 3589-3595, 4222-4262, 6940-7051 and 7052. In another embodiment, the peptide of (ll) has the sequence selected from the group consisting of SEQ ID NO: 75, 1060-1071, 2723-2729, 3203-3216, 3456-3457, 3596-3600, 4263-4297, 7053-7272 and 7273. In another embodiment, the peptide of (mm) has the sequence selected from the group consisting of SEQ ID NO: 76-77, 1072-1080, 3458, 3601, 4298-4311, 7274-7378 and 7379. In another embodiment, the peptide of (nn) has the sequence selected from the group consisting of SEQ ID NO: 4312-4317, 7380-7408 ad 7409. In another embodiment, the peptide of (oo) has the sequence selected from the group consisting of SEQ ID NO: 4318, 7410-7425 and 7426. In another embodiment, the peptide of (pp) has the sequence selected from the group consisting of SEQ ID NO: 3602, 4319-4327, 7427-7452 and 7453. In another embodiment, the peptide of (qq) has the sequence selected from the group consisting of SEQ ID NO: 3603, 4328-4378, 7454-7617 and 7618. In another embodiment, the peptide of (rr) has the sequence selected from the group consisting of SEQ ID NO: 1081-1183, 2730-2740, 3217-3221, 3459-3460, 3604-3634, 4379-4430, 7619-7693 and 7694. In another embodiment, the peptide of (ss) has the sequence selected from the group consisting of SEQ ID NO: 4431-4435, 7695-7711 and 7712. In another embodiment, the peptide of (tt) has the sequence selected from the group consisting of SEQ ID NO: 1184-1187, 4436, 7713-7751 and 7752. In another embodiment, the peptide of (uu) has the sequence selected from the group consisting of SEQ ID NO: 1188-1197, 2741-2747, 3222-3225, 4437-4444, 7753-7770 and 7771. In another embodiment, the peptide of (vv) has the sequence selected from the group consisting of SEQ ID NO: 4445-4447, 7772-7781 and 7782. In another embodiment, the peptide of (ww) has the sequence selected from the group consisting of SEQ ID NO: 78-111, 1198-1273, 2748-2788, 3226-3254, 3461-3463, 3635-3650, 4448-4565, 7783-8034 and 8035. In another embodiment, the peptide of (xx) has the sequence selected from the group consisting of SEQ ID NO: 112-151, 1274-1308, 2789-2825, 3255-3279, 3651-3655, 4566-4608, 8036-8179 and 8180. In another embodiment, the peptide of (yy) has the sequence selected from the group consisting of SEQ ID NO: 152-153, 1309-1329, 2826, 3280-3287, 3656, 8181-8200 and 8201. In another embodiment, the peptide of (zz) has the sequence selected from the group consisting of SEQ ID NO: 154-171, 1330-1385, 2827-2840, 3288-3301, 3464, 3657, 4609-4626, 8202-8309 and 8310. In another embodiment, the peptide of (aaa) has the sequence selected from the group consisting of SEQ ID NO: 4627, 8311-8212 and 8313. In another embodiment, the peptide of (bbb) has the sequence selected from the group consisting of SEQ ID NO: 172, 1386-1412, 2841-2845, 3302-3313, 3658-3661, 4628-4640, 8314-8338 and 8339. In another embodiment, the peptide of (ccc) has the sequence selected from the group consisting of SEQ ID NO: 3465-3467, 4641-4654, 8340-83402 and 8403. In another embodiment, the peptide of (ddd) has the sequence selected from the group consisting of SEQ ID NO: 1413-1417, 3314, 3468-3491, 3662-3674, 4655-4738, 8404-8619 and 8620. In another embodiment, the peptide of (eee) has the sequence selected from the group consisting of SEQ ID NO: 1418-1424, 2846-2856, 3315-3321, 3492-3494, 3675-3713, 4739-4823, 8621-8860 and 8861. In another embodiment, the peptide of (fff) has the sequence selected from the group consisting of SEQ ID NO: 1425-1432, 2857-2858, 3322-3329, 4824-4829, 8862-8900 and 8901. In another embodiment, the peptide of (ggg) has the sequence selected from the group consisting of SEQ ID NO: 173-175, 1433-1508, 2859-2872, 3330-3384, 4830-4833, 8902-8923 and 8924. In another embodiment, the peptide of (hhh) has the sequence selected from the group consisting of SEQ ID NO: 1509-1514, 3495, 3714-3725, 4834-4845, 8925-8948 and 8949. In another embodiment, the peptide of (iii) has the sequence selected from the group consisting of SEQ ID NO: 1515-1518, 2873, 4846-4850, 8950-8965 and 8966. In another embodiment, the peptide of (jjj) has the sequence selected from the group consisting of SEQ ID NO: 176-179, 1519-1532, 2874-2878, 3385-3392 and 3393. In another embodiment, the peptide of (kkk) has the sequence selected from the group consisting of SEQ ID NO: 180-204, 1533-1589, 2879-2891, 3394-3410, 3496-3498, 3726-3731, 4851-4922, 8967-9147 and 9148. In another embodiment, the peptide of (lll) has the sequence selected from the group consisting of SEQ ID NO: 4923-4931, 9149-9181 and 9182. In another embodiment, the peptide of (mmm) has the sequence selected from the group consisting of SEQ ID NO: 1590-1591, 2892, 3732-3733, 4932-4937, 9183-9227 and 9228. In another embodiment, the peptide of (nnn) has the sequence selected from the group consisting of SEQ ID NO: 205-207, 1592-1795, 2893-2911, 3411-3426, 3734-3745, 4938-4959, 9229-9287 and 9288. In another embodiment, the peptide of (000) has the sequence selected from the group consisting of SEQ ID NO: 208, 1796-1804, 2912-2913, and 3427. In another embodiment, the peptide of (ppp) has the sequence selected from the group consisting of SEQ ID NO: 4960-4976, 9289-9389 and 9390. In another embodiment, the peptide of (qqq) has the sequence selected from the group consisting of SEQ ID NO: 1805, 3746-3749, 4977-4988, 9391-9416 and 9417. In another embodiment, the peptide of (rrr) has the sequence selected from the group consisting of SEQ ID NO: 209-341, 1806-2482, 2914-2943, 3428-3439, 4989-4990, 9418-9431 and 9432. In another embodiment, the peptide of (sss) has the sequence selected from the group consisting of SEQ ID NO: 342-349, 2483-2553, 2944-2948, 3440-3442, 4991-4997, 9433-9439 and 9440. In another embodiment, the peptide of (ttt) has the sequence selected from the group consisting of SEQ ID NO: 4998-4999, 9441-9458 and 9459. In another embodiment, the peptide of (uuu) has the sequence of SEQ ID NO:2554. In another embodiment, the peptide of (vvv) has the sequence selected from the group consisting of SEQ ID NO: 9471-9472, and 9489. In another embodiment, the peptide of (www) has the sequence selected from the group consisting of SEQ ID NO: 9460-9469 and 9470. In another embodiment, the peptide of (xxx) has the sequence selected from the group consisting of SEQ ID NO: 9479-9480, and 9483. In another embodiment, the peptide of (yyy) has the sequence of SEQ ID NO:9487. In another embodiment, the peptide of (zzz) has the sequence selected from the group consisting of SEQ ID NO: 9473-9474, and 9488. In another embodiment, the peptide of (aaaa) has the sequence selected from the group consisting of SEQ ID NO: 9475-9476, and 9486. In another embodiment, the peptide of (bbbb) has the sequence selected from the group consisting of SEQ ID NO: 9477-9478, and 9485. In another embodiment, the peptide of (cccc) has the sequence selected from the group consisting of SEQ ID NO: 9481-9482, and 9484. In another or further embodiment of any of the foregoing embodiments, the peptide fragment is fused to a delivery peptide. In a further embodiment, the delivery peptide comprises a targeting peptide. In yet a further embodiment, the peptide fragment further comprises a cell penetrating peptide (CPP). In another embodiment, the delivery peptide comprises a cell penetrating peptide (CPP). In a further embodiment, the CPP is linked to the N-terminus or C-terminus of the peptide fragment. In a further embodiment, the fusion construct further comprises a peptide linker between the CPP and the peptide fragment. The disclosure also provide a peptide as described in any of the foregoing embodiments, wherein the peptide is linked to a nanoparticle. The disclosure also provides a polynucleotide or oligonucleotide encoding a peptide fragment of as describe above and herein. The disclosure further provides a vector comprising the polynucleotide or oligonucleotide. The vector can be a viral vector such as an adenoviral, gammaviral or lentiviral vector. The disclosure also provides a recombinant cell comprising an oligonucleotide, polynucleotide or vector of the disclosure.

The disclosure also provides a method of treating a cancer in a subject, comprising administering a composition comprising any one or more of (a)-(uuu) (above), wherein a peptide (a)-(uuu) has a dominant-negative effect and inhibits cancer growth, invasiveness or migration. In one embodiment, the cancer is selected from the group consisting of: adrenocortical carcinoma, AIDS-related cancers, AIDS-related lymphoma, anal cancer, anorectal cancer, cancer of the anal canal, appendix cancer, childhood cerebellar astrocytoma, childhood cerebral astrocytoma, basal cell carcinoma, skin cancer (non-melanoma), biliary cancer, extrahepatic bile duct cancer, intrahepatic bile duct cancer, bladder cancer, urinary bladder cancer, bone and joint cancer, osteosarcoma and malignant fibrous histiocytoma, brain cancer, brain tumor, brain stem glioma, cerebellar astrocytoma, cerebral astrocytoma/malignant glioma, ependymoma, medulloblastoma, supratentorial primitive neuroectodermal tumors, visual pathway and hypothalamic glioma, breast cancer, including triple negative breast cancer, bronchial adenomas/carcinoids, carcinoid tumor, gastrointestinal, nervous system cancer, nervous system lymphoma, central nervous system cancer, central nervous system lymphoma, cervical cancer, childhood cancers, chronic lymphocytic leukemia, chronic myelogenous leukemia, chronic myeloproliferative disorders, colon cancer, colorectal cancer, cutaneous T-cell lymphoma, lymphoid neoplasm, mycosis fungoides, Seziary Syndrome, endometrial cancer, esophageal cancer, extracranial germ cell tumor, extragonadal germ cell tumor, extrahepatic bile duct cancer, eye cancer, intraocular melanoma, retinoblastoma, gallbladder cancer, gastric (stomach) cancer, gastrointestinal carcinoid tumor, gastrointestinal stromal tumor (GIST), germ cell tumor, ovarian germ cell tumor, gestational trophoblastic tumor glioma, head and neck cancer, hepatocellular (liver) cancer, Hodgkin lymphoma, hypopharyngeal cancer, intraocular melanoma, ocular cancer, islet cell tumors (endocrine pancreas), Kaposi Sarcoma, kidney cancer, renal cancer, laryngeal cancer, acute lymphoblastic leukemia, acute myeloid leukemia, chronic lymphocytic leukemia, chronic myelogenous leukemia, hairy cell leukemia, lip and oral cavity cancer, liver cancer, lung cancer, non-small cell lung cancer, small cell lung cancer, AIDS-related lymphoma, non-Hodgkin lymphoma, primary central nervous system lymphoma, Waldenstram macroglobulinemia, medulloblastoma, melanoma, intraocular (eye) melanoma, merkel cell carcinoma, mesothelioma malignant, mesothelioma, metastatic squamous neck cancer, mouth cancer, cancer of the tongue, multiple endocrine neoplasia syndrome, mycosis fungoides, myelodysplastic syndromes, myelodysplastic/myeloproliferative diseases, chronic myelogenous leukemia, acute myeloid leukemia, multiple myeloma, chronic myeloproliferative disorders, nasopharyngeal cancer, neuroblastoma, oral cancer, oral cavity cancer, oropharyngeal cancer, ovarian cancer, ovarian epithelial cancer, ovarian low malignant potential tumor, pancreatic cancer, islet cell pancreatic cancer, paranasal sinus and nasal cavity cancer, parathyroid cancer, penile cancer, pharyngeal cancer, pheochromocytoma, pineoblastoma and supratentorial primitive neuroectodermal tumors, pituitary tumor, plasma cell neoplasm/multiple myeloma, pleuropulmonary blastoma, prostate cancer, rectal cancer, renal pelvis and ureter, transitional cell cancer, retinoblastoma, rhabdomyosarcoma, salivary gland cancer, ewing family of sarcoma tumors, soft tissue sarcoma, uterine cancer, uterine sarcoma, skin cancer (non-melanoma), skin cancer (melanoma), papillomas, actinic keratosis and keratoacanthomas, merkel cell skin carcinoma, small intestine cancer, soft tissue sarcoma, squamous cell carcinoma, stomach (gastric) cancer, supratentorial primitive neuroectodermal tumors, testicular cancer, throat cancer, thymoma, thymoma and thymic carcinoma, thyroid cancer, transitional cell cancer of the renal pelvis and ureter and other urinary organs, gestational trophoblastic tumor, urethral cancer, endometrial uterine cancer, uterine sarcoma, uterine corpus cancer, vaginal cancer, vulvar cancer, and Wilm's Tumor.

The disclosure also provides a method of treating an infection by a betacoronavirus, the method comprising administering a composition of of any one or more of (vvv)-(cccc), wherein the composition inhibits the binding of a betacoronavirus to a receptor-ligand on a human cell.

The disclosure also provides a screening method to identify one or more peptide sequences that modulate functional regions of target protein(s), comprising: synthesizing a library of overlapping gene fragments from one or more genes that express the target protein(s), wherein each gene fragment has a unique nucleotide sequence, wherein each gene fragment from the same gene that express a target protein has a sequence which partial overlaps with the sequences of least two or more gene fragments having nucleotide sequences from the same gene; pooling and cloning the gene fragments into vectors, wherein each vector overexpresses one gene fragment when transduced or transfected into a cell; transfecting or transducing cells with the vectors comprising gene fragments, wherein each transduced or transfected cell has only one vector that comprises a gene fragment; screening the transfected or transduced cells for a phenotypic characteristic associated with target protein activity; sequencing and quantifying gene fragment abundance from cells exhibiting the phenotypic characteristic; and mapping the sequenced gene fragments back to the gene that express the target protein and providing a modulation score for each codon, wherein the modulation score is defined as the mean depletion/enrichment of all overlapping sequenced gene fragments, and wherein codons of the gene fragments which have a modulation score above or below a $p=0.05$ significance threshold, indicates peptide sequences which modulate functional regions of the target proteins. In one embodiment, the library of overlapping gene fragments is synthesized using pooled DNA oligonucleotide synthesis on a solid substrate. In another or further embodiment, the gene fragments are 60 nucleotides to 300 nucleotides in length. In another embodiment, the gene fragments are 120 nucleotides in length. In another embodiment, the target protein(s) are associated with a disease of disorder. In another embodiment, the disease or disorder is cancer, Alzheimer's disease or a neurodegenerative tauopathy disorder. In another embodiment, the genes expressing target proteins are tumor suppressor genes, pro-apoptotic genes or oncogenes. In another embodiment, the vectors are viral vectors. In another embodiment, the viral vectors are recombinant retroviral vectors, adenoviral vectors, adeno-associated viral vectors, alphaviral vectors, or lentiviral vectors. In another embodiment, the viral vectors are lentiviral vectors. In another embodiment, the phenotypic characteristic is cell growth. In another embodiment, the phenotypic characteristic is immunostimulatory/immunosuppressive activity. In another embodiment, the phenotypic characteristic is neurodegenerative tauopathy. In another embodiment, the modulation score is a depletion score indicating that the identified peptides inhibit or suppress the functional activity of target proteins. In another embodiment, the modulation score is an enrichment score indicating that the identified peptides enhance the functional activity of target proteins.

The disclosure also provides a screening method to identify one or more peptide sequences that inhibit functional regions of target protein(s) expressed by oncogenes, comprising: synthesizing a library of overlapping gene fragments from one or more oncogenes that express the target protein(s), wherein each gene fragment has a unique nucleotide sequence, wherein each gene fragment from the same gene that express a target protein has a sequence which partial overlaps with the sequences of least two or more gene fragments having nucleotide sequences from the same gene; pooling and cloning the gene fragments into vectors, wherein each vector overexpresses one gene fragment when transduced or transfected into a cell; transfecting or transducing cells with the vectors comprising gene fragments, wherein each transduced or transfected cell has only one vector that comprises a gene fragment; screening the transfected or transduced cells for cell growth over various time points; sequencing and quantifying gene fragment abundance from each of the time points; and mapping the sequenced gene fragments back to the oncogene that express the target protein and providing a depletion score for each codon, wherein the depletion score is defined as the mean depletion/enrichment of all overlapping sequenced gene fragments, and wherein codons of the gene fragments which have a depletion score below a $p=0.05$ significance threshold, indicates peptide sequences which inhibit functional regions of the target proteins expressed by the oncogenes. In another embodiment, the library of overlapping gene fragments is synthesized using pooled DNA oligonucleotide synthesis on a solid substrate. In another embodiment, the gene fragments are 60 nucleotides to 300 nucleotides in length. In another embodiment, the gene fragments are 120 nucleotides in length. In another embodiment, the vectors are viral vectors. In another embodiment, the viral vectors are recombinant retroviral vectors, adenoviral vectors, adeno-associated viral vectors, alphaviral vectors, or lentiviral vectors. In another embodiment, the viral vectors are lentiviral vectors. In another embodiment, the oncogenes includes one or more oncogenes selected from MCL-1, BCR, BRAF, JAK1, JAK2, VEGF, EGFR, ALK, CDK1, CDK2, CDK3, CDK3, CDK4, BRCA, PIK3CA, MEK, C-KIT, NRAS, ABCB11, ANTXR2, BCOR, CDKN1B, CYP27A1, EMD, FANCF, ABCC8, APC, BCORL1, CDKN2A, CYP27B1, EP300, FANCG, ABCC9, AR, BLM, CEP290, DAXX, EPCAM, FANCI, ABCD1, ARID1A, BMPR1A, CFTR, DBT, EPHAS, FANCL, ABL1, ARID2, RAF1, CHEK1, DCC, EPHB2, FANCM, ACADM, ARSA, BRCA1, CHEK2, DCX, ERBB2, FAS, CADS, ASAH1, BRCA2, CHM, DDB2, ERBB3, FAT3, ACADVL, ASCC1, BRIP1, CIC, DDR2, ERBB4, FBXO11, ACTC1, ASL, BTD, CLN3, DES, ERCC2, FBXO32, ACTN2, ASPA, BTK, CLNS, DHCR7, ERCC3, FBXW7, ACVR1B, ASS1, BUB1B, CLN6, DICER1, ERCC4, FGD4, ADA, ASXL1, CALR3, CLN8, DIS3L2, ERCC5, FGFR1, ADAMTS13, ATM, CARD11, COL1A2, DKC1, ERCC6, FGFR2, ADAMTS2, ATP4A, CASP8, COL4A3, DLD, ERRFI1, FGFR3, AGA, ATP6V0D2, CAV3, COL4A4, DMD, ESCO2, FH, AGL, ATP7A, CBFB, COL7A1, DNAJB2, ESR1, FKTN, AGPS, ATP7B, CBL, COX15, DNMT3A, ETV6, FLCN, AHI1, ATP8B1, CBLB, CREBBP, DSC2, EXOC2, FLT3, AIP, ATR, CBLC, CRLF2, DSE, EXT1, FMR1, AKAP9, ATRX, CBS, CRTAP, DSC2, EXT2, FUBP1, AKT1, AXIN1, CCDC178, CRYAB, DSP, EYA4, FZD3, AKT2, AXIN2, CCNE1, CSF1R, DTNA, EZH2, G6PC, ALB, BAG3, CD79A, CSMD3, ECT2L, F11, GAA, ALDH3A2, BAI3, CD79B, CSRP3, EDA, F5, GABRA6, ALDOB, BAP1, CD96, CTNNB1, EDN3, FAH, GALNT12, ALK, BARD1, CDC27, CTNS, EDNRB, FAM46C, GALT, ALS2, BAX, CDC73, CTSK, EED, FANCA, GATA1, AMER1, BAZ2B, CDH1, CUBN, EGFR, FANCB, GATA2, AMPD1, BCKDHA, CDH23, CYLD, EGR2, FANCC, GATA3, AMPH, BCKDHB, CDK12, CYP11A1, EHBP1, FANCD2, GATAD1, ANTXR1, BCL6, CDK4, CYP21A2, ELMO1, FANCE, GBA, GCDH, JAK1, MDM2, NEK2, PLOD1, ROS1, SMPD1, GJB2, JAK2, MECP2, NEXN, PLP1, RPGRIP1L, SOX10, GLA, JAK3, MED12, NF1, PMP22, RS1, SOX2, GLB1, JUP, MEFV, NF2, PMS2, RSPO1, SPEG, GLI1, KAT6A, MEN1, NFE2L2, POLD1, RTEL1, SPOP, GLI3, KCNQ1, MET, NFKBIA, POLE, RUNX1, SRC, GLMN, KDM4B, MFSD8, NIPA2, POLH, RUNX1T1, SSTR1, GNA11, KDM6A, MIER3, NKX3-1, POMGNT1, RYR2, STAG2, GNAQ, KDR, MITF, NOTCH1, POMT1, S1PR2, STAR, GNAS, KEAP1, MKS1, NOTCH2, POU1F1, SAMD9L, STK11, GNPTAB, KIF1B, MLH1, NPC1, POU6F2, SBDS, SUFU, GPC3, KIT, MLH3, NPC2, PPM1L, SCN11A, SUZ12, GPC6, KLF6, MMAB, NPHP1, PPP2R1A, SCN5A, SYNE3, GPR78, KLHDC8B, MPL, NPHP4, PPT1, SCNN1A, TAZ, GRIN2A, KMT2A, MPZ, NPM1, PRDM1, SCNN1B, TBX20, GRM8, KMT2C, MRE11A, PRKAG2, SCNN1G, TCAP, GXYLT1, KMT2D, MSH2, NRCAM, PRKAR1A, SCO2, TCERG1, H3F3A, KRAS, MSH3, NTRK1, PRKDC, SDHA, TCF7L2, HADHA, KREMEN1, MSH6, NUP62, PROC, SDHAF2, TERT, HADHB, L1CAM, MSMB, OR5L1, PROP1, SDHB, TET2, HBB, LAMA2, MSR1, OTC, PRPF40B, SDHC, TFG, HESX1, LAMA4, MTAP, OTOP1, PRX, SDHD, TGFB3, HEXA, LAMP2, MTHFR, PAH, PSAP, SEPT9, TGFBR1, HEXB, LDB3, MTM1, PALB2, PSEN1, SETBP1, TGFBR2, HFE, LEPRE1, MTOR, PALLD, PSEN2, SETD2, THSD7B, HGSNAT, LIG4, MUC16, PAX5, PTCH1, SF1, TINF2, HIST1H3B, LMNA, MUT, PAX6, PTCH2, SF3A1, TMC6, HNF1A, LPAR2, MUTYH, PBRM1, PTEN, SF3B1, TMC8, HRAS, LRP1B, MYBPC3, PCDH15, PTGFR, SGCD, TMEM127, HSPH1, LRPPRC, MYC, PCGF2, PTPN11, SGSH, TMEM43, IDH1, LRRK2, MYD88, PDE11A, PTPN12, SH2B3, TMEM67, IDH2, LYST, MYH6, PDGFRA, RAC1, SLC25A4, TMPO, IGF2R, MAP2K1, MYH7, PDHA1, RAD21, SLC26A2, TNFAIP3, IGHMBP2, MAP2K2, MYL2, PDZRN3, RAD50, SLC37A4, TNFRSF14, IGSF10, MAP2K4, MYL3, PEX1, RAD51B, SLC7A8, TNNC1, IKBKAP, MAP3K1, MYLK2, PEX7, RAD51C, SLC9A9, TNNI3, IKZF1, MAP4K3, MYO1B, PHF6, RAD51D, SLX4, TNNT1, IKZF4, MAP7, MYO7A, PIK3CA, RARB, SMAD2, TNNT2, IL2RG, MAPK10, MYOZ2, PIK3CG, RB1, SMAD4, TP53, IL6ST, MAS1L, MYPN, PIK3R1, RBM20, SMARCA4, TPM1, IL7R, MAX, NBN, PKHD1, RECQL4, SMARCB1, TPP1, INVS, MC1R, NCOA2, PKP2, RET, SMC1A, TRAF5, IRAK4, MCCC2, NCOR1, PLEKHG5, RHBDF2, SMC3, TRIO, ITCH, MCOLN1, NDUFA13, PLN, RNASEL, SMO, TRPV4, TRRAP, U2AF1, USH1C, WAS, WWP1, ZIC3, TSC1, U2AF2, USH1G, WBSCR17, XPA, ZNF2, TSC2, UBA1, USP16, WEE1, XPC, ZNF226, TSHB, UBR3, USP25, WNK2, XRCC3, ZNF473, TSHR, UROD, VCL, WRN, ZBED4, ZNF595, TTN, UROS, VHL, WT1, ZFHX3, HER2, and ZRSR2. In another embodiment, the one or more oncogenes are selected from KRAS, HRAS, NRAS, RAF1, BRAF, ARAF, Myc, Max, FBXW7, and EGFR. The disclosure also provides a peptide comprising a sequence that inhibits functional regions of target protein(s) expressed by oncogenes identified by the method of the disclosure. In another embodiment, the peptide inhibits the functional regions of EGFR and has the sequence of EGFR-697 or inhibits the function regions of RAF1 and has the sequence of RAF1-73.

The disclosure also provides an isolated polypeptide or peptide comprising, consisting essentially of or consisting of a sequence that is 85%, 87%, 90%, 92%, 94%, 95%, 98%, 99% or 100% identical to any one sequence as set forth SEQ ID NOs: 1-9489. In another embodiment, the peptide inhibits cancer cell growth, invasion, metastasis, and/or migration or inhibits the ability of a betacoronavirus to infect a cell. In another embodiment, the peptide further comprises a cell penetrating peptide (CPP) linked to the N-terminus or C-terminus of the isolated polypeptide or peptide. In another embodiment, the construct comprises a peptide linker between the CPP and the polypeptide or peptide. In still another embodiment, a nanoparticle can be linked to a polypeptide or peptide of the disclosure.

DESCRIPTION OF DRAWINGS

FIG. 6A-G shows overall analyses and extended metrics for expanded cancer driver screens: (A) Table detailing all the peptides assayed in the expanded wildtype driver screen.

Figure 1A:
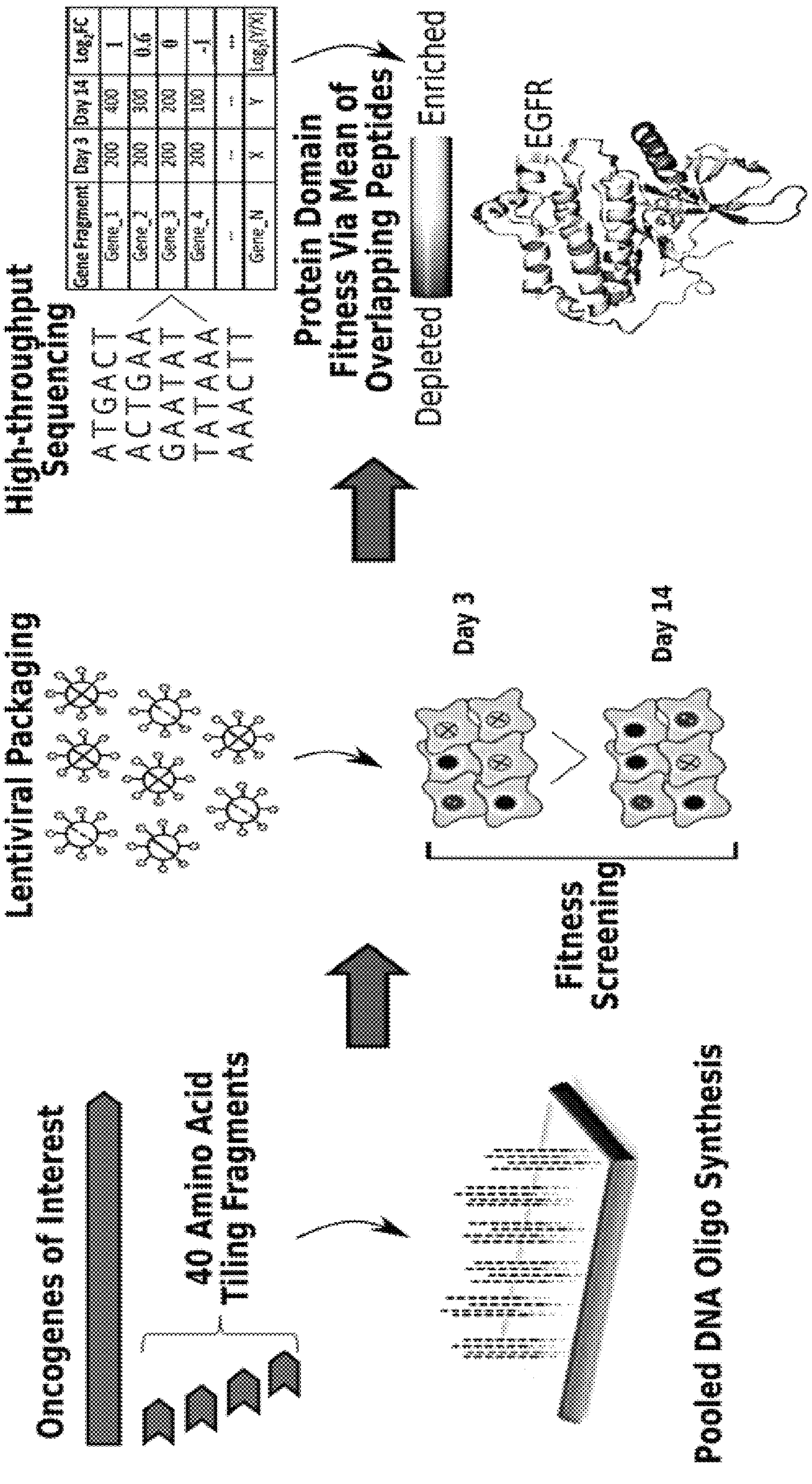
FIG. 1A-C shows an overview of experimental design and initial results: (A) Design of overlapping gene fragment library. Gene fragments coding for all possible overlapping 40 mer peptides were computed from target gene cDNA sequences. Gene fragment sequences were then generated via chip-based oligonucleotide synthesis and cloned into a lentiviral plasmid vector. This plasmid library was in turn used to generate lentiviral particles via transient transfection. The lentiviral particles were then used to infect target mammalian cell lines at a low MOI to ensure only one gene fragment was expressed per cell. The cells were then grown for two weeks, with genomic DNA extracted at day 3 and day 14. Next, gene fragments were PCR amplified from genomic DNA and sequenced to track fragment abundances and calculate $\log_2$ enrichment and depletion. Gene fragments were mapped back to target gene coding sequences, and each codon/amino acid was given a fitness score defined as the Z-normalized mean $\log_2$ fold change of all overlapping gene fragments. (B) Resulting amino acid level fitness scores. Screening data from Hs578T and MDA-MB-231 cells shows conserved regions of fitness dependencies, as well as cell line specific fitness dependencies. The heatmap shows the fitness score for each amino acid position (sorted in ascending order from top to bottom) across all proteins assayed in the screen. On the right, plots showing the statistical likelihood of depletion are shown for RAF1, EGFR, BRAF, and FBXW7. Peptides overlapping amino acid positions with known functional roles are significantly depleted over the course of cell growth. (C) The fitness effects of peptides derived from known pathogenic and dominant negative Ras mutants. KRASQ61K is significantly depleted in both cell lines, while HRAS S17N is depleted only in HRAS mutant Hs578T cells.

Genes comprising diverse cancer associated signaling pathways and processes. (B) Computed per position amino acid scores had good correlation between replicates (Pearson=0.917), with reproducibility exceeding that of the pilot screen. It was hypothesized the greater effect size of deleterious peptides contained in the larger library (see FIG. 2A) likely drives improved signal to noise ratio. As in the pilot screen the majority of amino acid positions in the full-length protein structures are not implicated in cell fitness, consistent with accepted understanding that protein-protein interactions directly driving oncogenic proliferation are rare. (C) The fitness score for the most deleterious residue in each full-length protein is plotted for each gene. GFP and HPRT1 controls show little effect on cell fitness across protein structure. (D) Per position fitness scores for RASA1, RRAS2, FLT3, DICER1, RB1, and ERBB4. Select PPIs are annotated on the plots, corresponding to regions of significant depletion. (E) Replicate correlation for mutant peptide screen. Screen shows high degree of reproducibility (Pearson correlation=0.859). As in the previously presented screens, the majority of mutant amino acid motifs assayed have no effect on cell fitness. (F) Table detailing all the peptides assayed in the mutant screen. Mutant genes cover a wide range of signaling pathways and molecular functions. (G) Plot of wild type (gray bars) and mutant amino acid fitness scores (points) for PIK3CA, BRAF, and SMAD4. Points labeled in red were significantly (BH adjusted P value <0.05) depleted in the pooled screen.

FIG. 7A-E shows individual validations of antiproliferative peptides: (A-B) Plots showing the correlation between peptide depletion versus charge and hydrophobicity. There is little correlation between charge/hydrophobicity and peptide log fold change, indicating that gross physiochemical factors do not mediate peptide effects on fitness. (C) Growth kinetics in Hs578T for individual peptide variants shown in FIG. 3A. Cell growth was quantified via the WST-8 proliferation assay. Results are from the same experiment split into multiple plots for ease of visualization, hence identical GFP controls for each peptide group. Arrayed validation of lentivirally delivered gene fragments derived from KRAS mutants is also shown. KRAS61K mutant peptides predicted to be deleterious to cell growth significantly inhibited growth (P<0.05, as measured at the 7 day time point). (D) Growth kinetics in MDA-MB-231 for individual peptide variants shown in FIG. 3A. Cell growth was quantified via the WST-8 proliferation assay. Results are from the same experiment split into multiple plots for ease of visualization, hence identical GFP controls for each peptide group. Arrayed validation of lentivirally delivered gene fragments derived from KRAS mutants is also shown. KRAS61K mutant peptides predicted to be deleterious to cell growth significantly inhibited growth (P<0.05, as measured at the 7 day time point). (E) Validation of peptide expression via immunofluorescence. Peptides were transduced with lentivirus 72 hours before immunostaining and imaging.

Figure 8A:
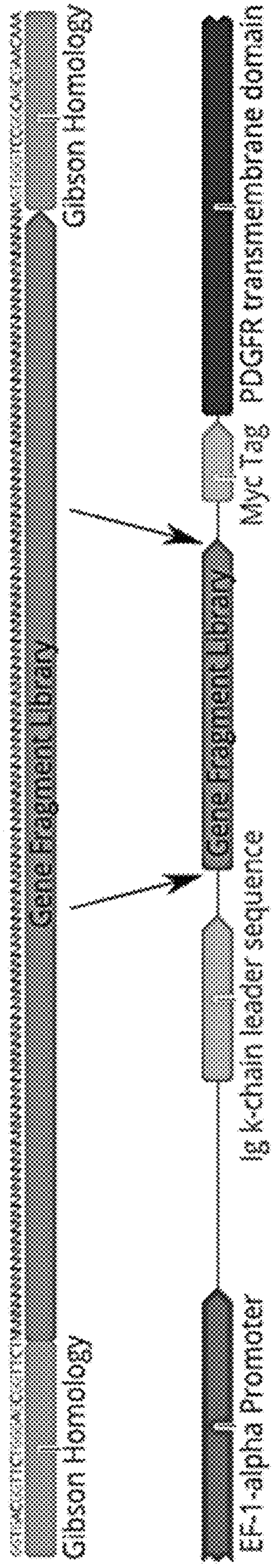
Figure 8B:
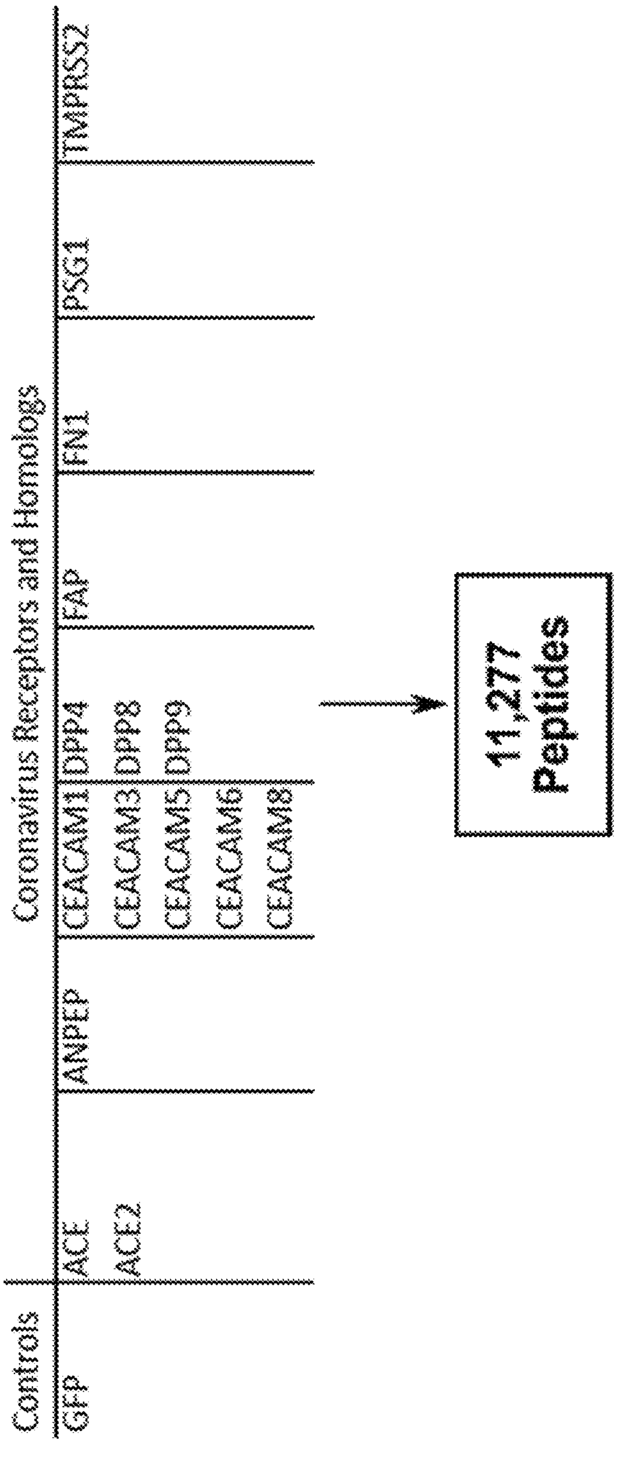

FIG. 8A-C shows Betacoronavirus peptide library cloning strategy and computational validation: (A) Cloning strategy and vector design for cell surface PepTile. Gene fragment libraries were synthesized as single stranded oligonucleotides and converted to double stranded DNA via PCR (depicted is SEQ ID NO: 9720). This library was then cloned into a cell surface expression vector via Gibson Assembly. Cell surface expression was obtained by cloning the gene fragment library between an N-terminal Ig Kappa leader peptide (to ensure secretion), and the PDGFR transmembrane domain (to provide anchoring on the cell membrane). (B) Genes from which peptide library was derived. Genes were chosen based on involvement in SARS-COV-2, SARS-COV, and/or MERS-COV cell entry. (C) Structural justification for ACE2 peptide inhibition: X-ray crystallography and Cryo-EM structures of SARS-COV2 spike protein receptor binding domain (RBD) complexed with ACE2 reveal that the binding interface stretches along two antiparallel alpha helices in the N-terminal domain of the protein (PDB structures 6M17, 6LZG, and 6M0J) 86-88. As specific examples, peptides covering each of these two helices and homologous ones from related proteins are shown sequentially below the structures (SEQ ID Nos: 9702-9718).

DETAILED DESCRIPTION

As used herein and in the appended claims, the singular forms "a," "an," and "the" include plural referents unless the context clearly dictates otherwise. Thus, for example, reference to "a cell" includes a plurality of such cells and reference to "the fragment" includes reference to one or more fragments and equivalents thereof known to those skilled in the art, and so forth.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Unless defined otherwise, all technical and scientific terms used herein have the same meaning as commonly understood to one of ordinary skill in the art to which this disclosure belongs. Although many methods and reagents are similar or equivalent to those described herein, the exemplary methods and materials are disclosed herein.

All publications mentioned herein are incorporated herein by reference in full for the purpose of describing and disclosing the methodologies, which might be used in connection with the description herein. Moreover, with respect to any term that is presented in one or more publications that is similar to, or identical with, a term that has been expressly defined in this disclosure, the definition of the term as expressly provided in this disclosure will control in all respects.

It should be understood that this disclosure is not limited to the particular methodology, protocols, and reagents, etc., described herein and as such may vary. The terminology used herein is for the purpose of describing particular embodiments or aspects only and is not intended to limit the scope of the present disclosure.

Other than in the operating examples, or where otherwise indicated, all numbers expressing quantities of ingredients or reaction conditions used herein should be understood as modified in all instances by the term "about." The term "about" when used to described the present invention, in connection with percentages means±1%. The term "about," as used herein can mean within an acceptable error range for the particular value as determined by one of ordinary skill in the art, which can depend in part on how the value is measured or determined, e.g., the limitations of the measurement system. Alternatively, "about" can mean a range of plus or minus 20%, plus or minus 10%, plus or minus 5%, or plus or minus 1% of a given value. Alternatively, particularly with respect to biological systems or processes, the term can mean within an order of magnitude, within 5-fold, or within 2-fold, of a value. Where particular values are described in the application and claims, unless otherwise stated the term "about" meaning within an acceptable error range for the particular value can be assumed. Also, where ranges and/or subranges of values are provided, the ranges and/or subranges can include the endpoints of the ranges and/or subranges. In some cases, variations can include an amount or concentration of 20%, 10%, 5%, 1%, 0.5%, or even 0.1% of the specified amount.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and o-phosphoserine. In some embodiments, an amino acid analogs refers to compounds that have the same basic chemical structure as a naturally occurring amino acid, i.e., a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. In some embodiments, an amino acid mimetics refers to chemical compounds that have a structure that is different from the general chemical structure of an amino acid, but that functions in a manner similar to a naturally occurring amino acid. The terms "non-naturally occurring amino acid" and "unnatural amino acid" refer to amino acid analogs, synthetic amino acids, and amino acid mimetics which are not found in nature. In certain instances one or more D-amino acids can be used in various peptide compositions of the disclosure. The disclosure provides various peptides that are useful for treating various diseases and infections. These peptides can comprise naturally occurring amino acid. In other embodiments, the peptides can comprise non-natural amino acids. The use of non-natural amino acids can improve the peptides stability, decrease degradation and/or improve biological activity. For example, in some embodiments, one or more D-amino acids. In other embodiments, retroinverso peptides are contemplated using various amino acid configurations.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

For purposes of the disclosure the term "cancer" will be used to encompass cell proliferative disorders, neoplasms, precancerous cell disorders and cancers, unless specifically delineated otherwise. Thus, a "cancer" refers to any cell that undergoes aberrant cell proliferation that can lead to metastasis or tumor growth. Exemplary cancers include but are not limited to, adrenocortical carcinoma, AIDS-related cancers, AIDS-related lymphoma, anal cancer, anorectal cancer, cancer of the anal canal, appendix cancer, childhood cerebellar astrocytoma, childhood cerebral astrocytoma, basal cell carcinoma, skin cancer (non-melanoma), biliary cancer, extrahepatic bile duct cancer, intrahepatic bile duct cancer, bladder cancer, urinary bladder cancer, bone and joint cancer, osteosarcoma and malignant fibrous histiocytoma, brain cancer, brain tumor, brain stem glioma, cerebellar astrocytoma, cerebral astrocytoma/malignant glioma, ependymoma, medulloblastoma, supratentorial primitive neuroectodermal tumors, visual pathway and hypothalamic glioma, breast cancer, including triple negative breast cancer, bronchial adenomas/carcinoids, carcinoid tumor, gastrointestinal, nervous system cancer, nervous system lymphoma, central nervous system cancer, central nervous system lymphoma, cervical cancer, childhood cancers, chronic lymphocytic leukemia, chronic myelogenous leukemia, chronic myeloproliferative disorders, colon cancer, colorectal cancer, cutaneous T-cell lymphoma, lymphoid neoplasm, mycosis fungoides, Seziary Syndrome, endometrial cancer, esophageal cancer, extracranial germ cell tumor, extragonadal germ cell tumor, extrahepatic bile duct cancer, eye cancer, intraocular melanoma, retinoblastoma, gallbladder cancer, gastric (stomach) cancer, gastrointestinal carcinoid tumor, gastrointestinal stromal tumor (GIST), germ cell tumor, ovarian germ cell tumor, gestational trophoblastic tumor glioma, head and neck cancer, hepatocellular (liver) cancer, Hodgkin lymphoma, hypopharyngeal cancer, intraocular melanoma, ocular cancer, islet cell tumors (endocrine pancreas), Kaposi Sarcoma, kidney cancer, renal cancer, laryngeal cancer, acute lymphoblastic leukemia, acute myeloid leukemia, chronic lymphocytic leukemia, chronic myelogenous leukemia, hairy cell leukemia, lip and oral cavity cancer, liver cancer, lung cancer, non-small cell lung cancer, small cell lung cancer, AIDS-related lymphoma, non-Hodgkin lymphoma, primary central nervous system lymphoma, Waldenstram macroglobulinemia, medulloblastoma, melanoma, intraocular (eye) melanoma, merkel cell carcinoma, mesothelioma malignant, mesothelioma, metastatic squamous neck cancer, mouth cancer, cancer of the tongue, multiple endocrine neoplasia syndrome, mycosis fungoides, myelodysplastic syndromes, myelodysplastic/myeloproliferative diseases, chronic myelogenous leukemia, acute myeloid leukemia, multiple myeloma, chronic myeloproliferative disorders, nasopharyngeal cancer, neuroblastoma, oral cancer, oral cavity cancer, oropharyngeal cancer, ovarian cancer, ovarian epithelial cancer, ovarian low malignant potential tumor, pancreatic cancer, islet cell pancreatic cancer, paranasal sinus and nasal cavity cancer, parathyroid cancer, penile cancer, pharyngeal cancer, pheochromocytoma, pineoblastoma and supratentorial primitive neuroectodermal tumors, pituitary tumor, plasma cell neoplasm/multiple myeloma, pleuropulmonary blastoma, prostate cancer, rectal cancer, renal pelvis and ureter, transitional cell cancer, retinoblastoma, rhabdomyosarcoma, salivary gland cancer, ewing family of sarcoma tumors, soft tissue sarcoma, uterine cancer, uterine sarcoma, skin cancer (non-melanoma), skin cancer (melanoma), papillomas, actinic keratosis and keratoacanthomas, merkel cell skin carcinoma, small intestine cancer, soft tissue sarcoma, squamous cell carcinoma, stomach (gastric) cancer, supratentorial primitive neuroectodermal tumors, testicular cancer, throat cancer, thymoma, thymoma and thymic carcinoma, thyroid cancer, transitional cell cancer of the renal pelvis and ureter and other urinary organs, gestational trophoblastic tumor, urethral cancer, endometrial uterine cancer, uterine sarcoma, uterine corpus cancer, vaginal cancer, vulvar cancer, and Wilm's Tumor. In a particular embodiment, the cancer can be selected from the group consisting of melanoma, colorectal cancer, pancreatic cancer, bladder cancer, breast cancer, triple negative breast cancer, ovarian cancer and lung cancer.

"Cells" according to the disclosure include any cell into which foreign gene fragments can be introduced and expressed as described herein or into which a drug-like peptide of the disclosure can be delivered. It is to be understood that the basic concepts of the disclosure described herein are not limited by cell type. Foreign gene fragments (i.e., those which are not part of a cell's natural nucleic acid composition) may be introduced into a cell using any method known to those skilled in the art for such introduction. Such methods include transfection, transduction, infection (e.g., viral transduction), injection, microinjection, gene gun, nucleofection, nanoparticle bombardment, transformation, conjugation, by application of the nucleic acid in a gel, oil, or cream, by electroporation, using lipid-based transfection reagents, or by any other suitable transfection method. One of skill in the art will readily understand and adapt such methods using readily identifiable literature sources.

The term "contacting" can mean direct or indirect binding or interaction between two or more entities. An example of direct interaction is binding. An example of an indirect interaction is where one entity acts upon an intermediary molecule, which in turn acts upon the second referenced entity. Contacting as used herein includes in solution, in solid phase, in vitro, ex vivo, in a cell and in vivo. Contacting in vivo can be referred to as administering, or administration.

As used herein, the term "detectable marker" or "selectable marker" can refer to at least one marker capable of directly or indirectly, producing a detectable signal. A non-exhaustive list of this marker includes enzymes which produce a detectable signal, for example by colorimetry, fluorescence, luminescence, such as horseradish peroxidase, alkaline phosphatase, β-galactosidase, glucose-6-phosphate dehydrogenase, chromophores such as fluorescent, luminescent dyes, groups with electron density detected by electron microscopy or by their electrical property such as conductivity, amperometry, voltammetry, impedance, detectable groups, for example whose molecules are of sufficient size to induce detectable modifications in their physical and/or chemical properties, such detection can be accomplished by optical methods such as diffraction, surface plasmon resonance, surface variation, the contact angle change or physical methods such as atomic force spectroscopy, tunnel effect, or radioactive molecules such as 32 P, 35 S or 125 I.

As used herein, the term "domain" can refer to a particular region of a protein or polypeptide, which can be associated with a particular function. For example, "a domain which binds to a cognate" can refer to the domain of a protein that binds one or more receptors or other protein moieties and (i) block the biological effect of a molecule that typically binds to the same receptor or protein or modulate the effect (i.e., increase or decrease) the biological activity of the naturally occurring binding partner of the protein or receptor.

As used herein the term "dominant-negative activity" can refer to the ability of a peptide or polypeptide of the disclosure to act as an inhibitor by binding to the wild type protein from which it is derived (i.e., from which it shares identity) or by titrating an essential ligand that binds with the protein from which the peptide is derived.

As used herein a "drug-like peptide" can refer to a polymer of amino acids comprising amide bonds that form a peptide, which does not occur in nature and which can be delivered to a cell, tissue or subject such that the biological effect results in a treatment of a disease, disorder infection or inhibits the progression of a disease, disorder or infection or which can prevent getting the disease, disorder or infection. In one embodiment, a drug-like peptide is a peptide having the sequence of any one of SEQ ID Nos: 1-9489. In another embodiment, a drug-like peptide is a peptide that is at least 95%, 96%, 97%, 98%, or 99% identical to a peptide having the sequence of any of SEQ ID Nos: 1-9489. In still another embodiment, a drug-like peptide has the sequence of any one of SEQ ID Nos: 1-9489, wherein one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40) of the amino acids is substitute with a non-naturally occurring or D-amino acid and which has the same biological activity (not necessarily to the same degree) as a peptide of the same sequence having all L-amino acids. A drug-like peptide can be formulated for suitable routes of delivery as a pharmaceutical composition and/or linked to a second domain having a similar or different biological activity. In some instances, a drug-like peptide can be fused to a peptide that functions to assist in delivery and/or uptake by a cell (e.g., a protein transduction domain).

The term "encode" as it is applied to polynucleotides can refer to a polynucleotide which is said to "encode" a polypeptide if, in its native state or when manipulated by methods well known to those skilled in the art, it can be transcribed and/or translated to produce the mRNA for the polypeptide and/or a fragment thereof. In some cases the antisense strand is the complement of such a nucleic acid, and the encoding sequence can be deduced therefrom.

The terms "equivalent" or "biological equivalent" are used interchangeably when referring to a particular molecule, biological, or cellular material and intend those having minimal homology while still maintaining desired structure or functionality.

"Eukaryotic cells" comprise all of the life kingdoms except monera. They can be easily distinguished through a membrane-bound nucleus. Animals, plants, fungi, and protists are eukaryotes or organisms whose cells are organized into complex structures by internal membranes and a cytoskeleton. One example of a membrane-bound structure is the nucleus. Unless specifically recited, the term "host" includes a eukaryotic host, including, for example, yeast, higher plant, insect and mammalian cells. Non-limiting examples of eukaryotic cells or hosts include simian, bovine, porcine, murine, rat, avian, reptilian and human.

As used herein, "expression" can refer to the process by which polynucleotides are transcribed into mRNA and/or the process by which the transcribed mRNA is subsequently being translated into peptides, polypeptides, or proteins. If the polynucleotide is derived from genomic DNA, expression can include splicing of the mRNA in a eukaryotic cell.

"Homology" or "identity" or "similarity" can refer to sequence similarity between two peptides or between two nucleic acid molecules. Homology can be determined by comparing a position in each sequence which can be aligned for purposes of comparison. For example, when a position in the compared sequence is occupied by the same base or amino acid, then the molecules are homologous at that position. A degree of homology between sequences is a function of the number of matching or homologous positions shared by the sequences. An "unrelated" or "non-homologous" sequence shares less than 40% identity, or alternatively less than 25% identity, with one of the sequences of the disclosure.

Homology refer to a percent (%) identity of a sequence to a reference sequence. As a practical matter, whether any particular sequence can be at least 50%, 60%, 70%, 80%, 85%, 90%, 92%, 95%, 96%, 97%, 98% or 99% identical to any sequence described herein, such particular peptide, polypeptide or nucleic acid sequence can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence, the parameters can be set such that the percentage of identity is calculated over the full length of the reference sequence and that gaps in homology of up to 5% of the total reference sequence are allowed.

For example, in a specific embodiment the identity between a reference sequence (query sequence, i.e., a sequence of the disclosure) and a subject sequence, also referred to as a global sequence alignment, can be determined using the FASTDB computer program based on the algorithm of Brutlag et al. (Comp. App. Biosci. 6:237-245 (1990)). In some cases, parameters for a particular embodiment in which identity is narrowly construed, used in a FASTDB amino acid alignment, can include: Scoring Scheme=PAM (Percent Accepted Mutations) 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject sequence, whichever is shorter. According to this embodiment, if the subject sequence is shorter than the query sequence due to N- or C-terminal deletions, not because of internal deletions, a manual correction can be made to the results to take into consideration the fact that the FASTDB program does not account for N- and C-terminal truncations of the subject sequence when calculating global percent identity. For subject sequences truncated at the N- and C-termini, relative to the query sequence, the percent identity can be corrected by calculating the number of residues of the query sequence that are lateral to the N- and C-terminal of the subject sequence, which are not matched/aligned with a corresponding subject residue, as a percent of the total bases of the query sequence. A determination of whether a residue is matched/aligned can be determined by results of the FASTDB sequence alignment. This percentage can be then subtracted from the percent identity, calculated by the FASTDB program using the specified parameters, to arrive at a final percent identity score. This final percent identity score can be used for the purposes of this embodiment. In some cases, only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence are considered for this manual correction. For example, a 90 residue subject sequence can be aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity can be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for.

"Hybridization" can refer to a reaction in which one or more polynucleotides react to form a complex that is stabilized via hydrogen bonding between the bases of the nucleotide residues. The hydrogen bonding can occur by Watson-Crick base pairing, Hoogstein binding, or in any other sequence-specific manner. The complex can comprise two strands forming a duplex structure, three or more strands forming a multi-stranded complex, a single self-hybridizing strand, or any combination of these. A hybridization reaction can constitute a step in a more extensive process, such as the initiation of a PC reaction, or the enzymatic cleavage of a polynucleotide by a ribozyme.

Examples of stringent hybridization conditions include: incubation temperatures of about 25° C. to about 37° C.; hybridization buffer concentrations of about 6×SSC to about 10×SSC; formamide concentrations of about 0% to about 25%; and wash solutions from about 4×SSC to about 8×SSC. Examples of moderate hybridization conditions include: incubation temperatures of about 40° C. to about 50° C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55° C. to about 68° C.; buffer concentrations of about 1x SSC to about 0.1× SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed.

The term "isolated" as used herein can refer to molecules or biologicals or cellular materials being substantially free from other materials. In one aspect, the term "isolated" can refer to nucleic acid, such as DNA or RNA, or protein or polypeptide (e.g., an antibody or derivative thereof), or cell or cellular organelle, or tissue or organ, separated from other DNAs or RNAs, or proteins or polypeptides, or cells or cellular organelles, or tissues or organs, respectively, that are present in the natural source. The term "isolated" also can refer to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments which are not naturally occurring as fragments and may not be found in the natural state. In some cases, the term "isolated" is also used herein to refer to polypeptides which are isolated from other cellular proteins and is meant to encompass both purified and recombinant polypeptides. In some cases, the term "isolated" is also used herein to refer to cells or tissues that are isolated from other cells or tissues and is meant to encompass both cultured and engineered cells or tissues.

"Messenger RNA" or "mRNA" is a nucleic acid molecule that is transcribed from DNA and then processed to remove non-coding sections known as introns. In some cases, the resulting mRNA is exported from the nucleus (or another locus where the DNA is present) and translated into a protein. The term "pre-mRNA" can refer to the strand prior to processing to remove non-coding sections.

The term "microorganism" or "microbe" refers to a microscopic organism, especially a bacterium, virus, or fungus.

The term "protein", "peptide" and "polypeptide" are used interchangeably and in their broadest sense to refer to a compound of two or more subunit amino acids, amino acid analogs or peptidomimetics. The subunits can be linked by peptide bonds. In another embodiment, the subunit can be linked by other bonds, e.g., ester, ether, etc. A protein or peptide can contain at least two amino acids and no limitation is placed on the maximum number of amino acids which can comprise a protein's or peptide's sequence. As mentioned above, the term "amino acid" can refer to either natural and/or unnatural or synthetic amino acids, including glycine and both the D and L optical isomers, amino acid analogs and peptidomimetics. As used herein, the term "fusion protein" can refer to a protein comprised of domains from more than one naturally occurring or recombinantly produced protein, where generally each domain serves a different function. In this regard, the term "linker" can refer to a peptide fragment that is used to link these domains together—optionally to preserve the conformation of the fused protein domains and/or prevent unfavorable interactions between the fused protein domains which can compromise their respective functions.

The terms "polynucleotide" and "oligonucleotide" are used interchangeably and refer to a polymeric form of nucleotides of any length, either deoxyribonucleotides or ribonucleotides or analogs thereof. Polynucleotides can have any three dimensional structure and can perform any function, known or unknown. The following are non-limiting examples of polynucleotides: a gene or gene fragment (for example, a probe, primer, EST or SAGE tag), exons, introns, messenger RNA (mRNA), transfer RNA, ribosomal RNA, RNAi, ribozymes, cDNA, recombinant polynucleotides, branched polynucleotides, plasmids, vectors, isolated DNA of any sequence, isolated RNA of any sequence, nucleic acid probes and primers. A polynucleotide can comprise modified nucleotides, such as methylated nucleotides and nucleotide analogs. If present, modifications to the nucleotide structure can be imparted before or after assembly of the polynucleotide. The sequence of nucleotides can be interrupted by non-nucleotide components. A polynucleotide can be further modified after polymerization, such as by conjugation with a labeling component. The term also can refer to both double and single stranded molecules. Unless otherwise specified or required, any embodiment of this disclosure that is a polynucleotide can encompass both the double stranded form and each of two complementary single stranded forms known or predicted to make up the double stranded form.

The term "polynucleotide sequence" can be the alphabetical representation of a polynucleotide molecule. This alphabetical representation can be input into databases in a computer having a central processing unit and used for bioinformatics applications such as functional genomics and homology searching.

Similarly, the term "polypeptide sequence", "peptide sequence" or "protein sequence" can be the alphabetical representation of a polypeptide molecule. This alphabetical representation can be input into databases in a computer having a central processing unit and used for bioinformatics applications such as functional proteomics and homology searching.

As used herein, the term "recombinant expression system" refers to a genetic construct or constructs for the expression of certain genetic material formed by recombination.

As used herein, the term "recombinant protein" can refer to a polypeptide or peptide which is produced by recombinant DNA techniques, wherein generally, DNA encoding the polypeptide or peptide is inserted into a suitable expression vector which is in turn used to transform a host cell to produce the heterologous polypeptide or peptide.

The term "sample" as used herein, generally refers to any sample of a subject (such as a blood sample or a tissue sample). A sample can comprise a tissue, a cell, serum, plasma, exosomes, a bodily fluid, or any combination thereof. A bodily fluid can comprise urine, blood, serum, plasma, saliva, mucus, spinal fluid, tears, semen, bile, amniotic fluid, or any combination thereof. A sample or portion thereof can comprise an extracellular fluid obtained from a subject. A sample or portion thereof can comprise cell-free nucleic acid, DNA or RNA. A sample can be a sample removed from a subject via a non-invasive technique, a minimally invasive technique, or an invasive technique. A sample or portion thereof can be obtained by a tissue brushing, a swabbing, a tissue biopsy, an excised tissue, a fine needle aspirate, a tissue washing, a cytology specimen, a surgical excision, or any combination thereof. A sample or portion thereof can comprise tissues or cells from a tissue type. For example, a sample can comprise a nasal tissue, a trachea tissue, a lung tissue, a pharynx tissue, a larynx tissue, a bronchus tissue, a pleura tissue, an alveoli tissue, breast tissue, bladder tissue, kidney tissue, liver tissue, colon tissue, thyroid tissue, cervical tissue, prostate tissue, heart tissue, muscle tissue, pancreas tissue, anal tissue, bile duct tissue, a bone tissue, brain tissue, spinal tissue, kidney tissue, uterine tissue, ovarian tissue, endometrial tissue, vaginal tissue, vulvar tissue, uterine tissue, stomach tissue, ocular tissue, sinus tissue, penile tissue, salivary gland tissue, gut tissue, gallbladder tissue, gastrointestinal tissue, bladder tissue, brain tissue, spinal tissue, a blood sample, or any combination thereof.

The term "sequencing" as used herein, can comprise bisulfite-free sequencing, bisulfite sequencing, TET-assisted bisulfite (TAB) sequencing, ACE-sequencing, high-throughput sequencing, Maxam-Gilbert sequencing, massively parallel signature sequencing, Polony sequencing, 454 pyrosequencing, Sanger sequencing, Illumina sequencing, SOLiD sequencing, Ion Torrent semiconductor sequencing, DNA nanoball sequencing, Heliscope single molecule sequencing, single molecule real time (SMRT) sequencing, nanopore sequencing, shot gun sequencing, RNA sequencing, Enigma sequencing, or any combination thereof.

The term "subject" as used herein, refers to an animal, including, but not limited to, a primate (e.g., human, monkey, chimpanzee, gorilla, and the like), rodents (e.g., rats, mice, gerbils, hamsters, ferrets, and the like), lagomorphs, swine (e.g., pig, miniature pig), equine, canine, feline, and the like. The terms "subject" and "patient" are used interchangeably herein. For example, a mammalian subject can refer to a human patient.

As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection (e.g., using commercially available reagents such as, for example, LIPOFECTIN® (Invitrogen Corp., San Diego, CA), LIPOFECTAMINE® (Invitrogen), FUGENE® (Roche Applied Science, Basel, Switzerland), JETPEI™ (Polyplus-transfection Inc., New York, NY), EFFECT-ENE® (Qiagen, Valencia, CA), DREAMFECT™ (OZ Biosciences, France) and the like), or electroporation. Suitable methods for transforming or transfecting host cells can be found in Sambrook, et al. (Molecular Cloning: A Laboratory Manual. 2nd, ed., Cold Spring harbor Laboratory, Cold Spring Harbor Laboratory Press, Cold Spring Harbor, N.Y., 1989), and other laboratory manuals. Standard recombinant DNA and molecular cloning techniques used herein are well known in the art and are described in Sambrook, J., Fritsch, E. F. and Maniatis, T., Molecular Cloning: A Laboratory Manual, $2^{nd}$ ed.; Cold Spring Harbor Laboratory: Cold Spring Harbor, N.Y., (1989) and by Silhavy, T. J., Bennan, M. L. and Enquist, L. W., Experiments with Gene Fusions; Cold Spring Harbor Laboratory: Cold Spring Harbor, N.Y., (1984); and by Ausubel, F. M. et. al., Current Protocols in Molecular Biology, Greene Publishing and Wiley-Interscience (1987) each of which are hereby incorporated by reference in its entirety. Additional useful methods are described in manuals including Advanced Bacterial Genetics (Davis, Roth and Botstein, Cold Spring Harbor Laboratory, 1980), Experiments with Gene Fusions (Silhavy, Berman and Enquist, Cold Spring Harbor Laboratory, 1984), Experiments in Molecular Genetics (Miller, Cold Spring Harbor Laboratory, 1972) Experimental Techniques in Bacterial Genetics (Maloy, in Jones and Bartlett, 1990), and A Short Course in Bacterial Genetics (Miller, Cold Spring Harbor Laboratory 1992) each of which are hereby incorporated by reference in its entirety.

The terms “treat”, “treating” and “treatment”, as used herein, refers to ameliorating symptoms associated with a disease or disorder (e.g., cancer, Covid-19 etc.), including preventing or delaying the onset of the disease or disorder symptoms, and/or lessening the severity or frequency of symptoms of the disease or disorder.

As used herein, the term “vector” can refer to a nucleic acid construct deigned for transfer between different hosts, including but not limited to a plasmid, a virus, a cosmid, a phage, a BAC, a YAC, etc. In some embodiments, a “viral vector” is defined as a recombinantly produced virus or viral particle that comprises a polynucleotide to be delivered into a host cell, either in vivo, ex vivo or in vitro. In some embodiments, plasmid vectors can be prepared from commercially available vectors. In other embodiments, viral vectors can be produced from baculoviruses, retroviruses, adenoviruses, AAVs, etc. according to techniques known in the art. In one embodiment, the viral vector is a lentiviral vector. Examples of viral vectors include retroviral vectors, adenovirus vectors, adeno-associated virus vectors, alphavirus vectors and the like. Infectious tobacco mosaic virus (TMV)-based vectors can be used to manufacturer proteins and have been reported to express Griffithsin in tobacco leaves (O'Keefe et al. (2009) Proc. Nat. Acad. Sci. USA 106(15):6099-6104). Alphavirus vectors, such as Semliki Forest virus-based vectors and Sindbis virus-based vectors, have also been developed for use in gene therapy and immunotherapy. See, Schlesinger & Dubensky (1999) Curr. Opin. Biotechnol. 5:434-439 and Ying et al. (1999) Nat. Med. 5(7):823-827. In aspects where gene transfer is mediated by a retroviral vector, a vector construct can refer to the polynucleotide comprising the retroviral genome or part thereof, and a gene of interest. Further details as to modern methods of vectors for use in gene transfer can be found in, for example, Kotterman et al. (2015) Viral Vectors for Gene Therapy: Translational and Clinical Outlook Annual Review of Biomedical Engineering 17. Vectors that contain both a promoter and a cloning site into which a polynucleotide can be operatively linked are well known in the art. Such vectors are capable of transcribing RNA in vitro or in vivo and are commercially available from sources such as Agilent Technologies (Santa Clara, Calif.) and Promega Biotech (Madison, Wis.). In one aspect, the promoter is a pol III promoter.

Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as “expression vectors.” In general, expression vectors of utility in recombinant DNA techniques are often in the form of plasmids. In the present specification, “plasmid” and ‘Vector” can be used interchangeably. However, the disclosure is intended to include such other forms of expression vectors, such as viral vectors (e.g., replication defective retroviruses, adenoviruses and adeno-associated viruses), which serve equivalent functions. Typically, the vector or plasmid contains sequences directing transcription and translation of a relevant gene or genes, a selectable marker, and sequences allowing autonomous replication or chromosomal integration. Suitable vectors comprise a region 5' of the gene which harbors transcriptional initiation controls and a region 3' of the DNA fragment which controls transcription termination. Both control regions may be derived from genes homologous to the transformed host cell, although it is to be understood that such control regions may also be derived from genes that are not native to the species chosen as a production host.

Typically, the vector or plasmid contains sequences directing transcription and translation of a gene fragment, a selectable marker, and sequences allowing autonomous replication or chromosomal integration. Suitable vectors comprise a region 5' of the gene which harbors transcriptional initiation controls and a region 3' of the DNA fragment which controls transcription termination. Both control regions may be derived from genes homologous to the transformed host cell, although it is to be understood that such control regions may also be derived from genes that are not native to the species chosen as a production host.

Initiation control regions or promoters, which are useful to drive expression of the relevant pathway coding regions in the desired host cell are numerous and familiar to those skilled in the art. Virtually any promoter capable of driving these genetic elements is suitable for the present invention including, but not limited to, lac, ara, tet, trp, IPL, IPR, T7, tac, and trc (useful for expression in Escherichia coli and Pseudomonas); the amy, apr, npr promoters and various phage promoters useful for expression in *Bacillus subtilis*, and *Bacillus licheniformis*; nisA (useful for expression in gram positive bacteria, Eichenbaum et al. Appl. Environ. Microbiol. 64(8):2763-2769 (1998)); and the synthetic P11 promoter (useful for expression in *Lactobacillus plantarum*, Rud et al., Microbiology 152:1011-1019 (2006)). Termination control regions may also be derived from various genes native to the preferred hosts.

Genetic screening has rapidly become a ubiquitous tool to probe protein function and accelerate drug discovery. Libraries of genetically encoded perturbations (CRISPR-Cas9 sgRNA, siRNA, etc.) enable high throughput identification of proteins essential to cancer cells fitness, disease progression and infectivity. However, existing screens typically fail to capture how proteins function biologically and provide little information on how to target hits therapeutically. Transposon mediated fragmentation and overexpression of cDNA has been used to identify peptide inhibitors of essential proteins in *Saccharomyces cerevisiae*. However, these libraries randomly generate gene fragments of various lengths hindering control of library composition, feature many out of frame fragments, and are limited in their translational relevance due to the choice of model organism. To overcome these challenges, provided herein is a platform-based screening methodology that uses overexpressed libraries of overlapping synthesized gene fragments that can be used to identify protein functional regions associated with an abnormal or disease cell fitness (e.g., cancer cell fitness), as well as dominant negative inhibitors of abnormal or disease cell growth (e.g., cancer cell growth) and as inhibitors of infectious agents.

Inhibitory peptides have immense potential as both research tools and therapeutics. Direct inhibition of protein activity without genetic alteration opens unique screening avenues with which to probe protein function. For example, protein-protein interaction networks could be more precisely perturbed via inhibitory peptides contacting a specific protein surface in contrast to complete genetic knockdown. The ability to identify protein regions associated with cell fitness can also serve to complement traditional drug development efforts, such as through determining critical residues for inhibition via small molecules or antibodies. Additionally, this screening method identifies inhibitory peptides that are immediately translatable, bypassing the need for additional high-throughput screens to identify candidate molecules.

Many proteins can be inhibited in a dominant negative fashion by short peptides/proteins derived from their own wild type coding sequence. Leveraging this fact, the disclosure provides compositions and methods that use a comprehensive lentiviral library of gene fragments tiling key oncogenes via a highly modular oligonucleotide synthesis protocol. This library was then used to conduct a pooled fitness screen, mining novel peptide motifs which selectively reduce cellular proliferation in breast cancer cell lines dependent on Ras/Myc signaling. Furthermore, by mapping peptides to their parent oncogenes (see, e.g., Table 1), conserved regions of depletion which revealed protein domains essential for cell fitness were identified. Coupling of cell penetrating motifs or other peptide delivery compositions to these peptides provides a drug-like function. Using the screening methods described herein, drugable peptide compositions were developed, such as for example, from EGFR and RAF1 which were able to inhibiting cell growth at $IC_{50}$s of 30-60 μM. Taken together, this approach enabled rapid discovery of potentially translatable peptide therapeutics, as well as de novo mapping of essential protein domains.

The screening strategy presented herein can probe protein functional regions with single amino acid resolution and can be readily scalable due to the ease of array-based oligonucleotide synthesis. In the exemplary studies presented herein, the platform-based screening methodology disclosed can identify peptide inhibitors of known oncogenes, including proteins, such as KRAS, that are a challenge to target using small molecule therapeutics. In addition, the screening methods of the disclosure were used to develop anti-infectivity agents that inhibit, e.g., viral infection such as infection by betaviruses (e.g., SARS-Cov2). As such, the screening methodology disclosed herein enables rapid discovery of potentially translatable peptide therapeutics and can be easily adaptable to diverse target genes and pathogenic contexts. These pathogenic contexts are not limited to cancer cell fitness. This methodology can be compatible with screening for higher level phenotypes via FACS, scRNAseq, as well as functional assays.

In a particular embodiment, the screening methodology described herein comprises providing a plurality of gene fragments which code for potentially inhibiting peptides for a targeted gene or genes (e.g., oncogenes, cell surface receptors, viral binding ligands etc.). The plurality of gene fragments may be generated by in silico pooled oligonucleotide synthesis technologies to generate large gene fragment libraries for use in the screening methods disclosed herein. Concepts from screening methodologies for CRISPR-based technologies can be used with the screening methodologies disclosed herein, including the CRISPR based screening methods found in Wang, T., Wei, J. J., Sabatini, D. M. & Lander, E. S., *Science* 343, 80-84 (2014); Gilbert, L. A. et al., *Cell* 159, 647-661 (2014); Shalem, O., Sanjana, N. E. & Zhang, F., *Nat Rev Genet* 16:299-311 (2015); Shalem, O. et al., *Science* 343, 84-87 (2014) each of which is hereby incorporated by reference in its entirety.

The disclosure provides synthesis of a gene fragment library using methods known to those of skill in the art. Gene fragments are then delivered to cells, using methods known to those in the art, including viral and non-viral methods. In a particular embodiment, the gene fragments are delivered to cells using lentiviral transduction. The disclosure provides that the cells may be cultured, such as under selective pressure and lysed and sequenced, such as deep-sequencing may be performed, to identify one or more nucleic acids from the library that are introduced into the cells using methods known to those of skill in the art, such as those described in Shalem, O., Sanjana, N. E. & Zhang, F., *Nat Rev Genet* 16:299-311 (2015); Shalem, O. et al., *Science* 343, 84-87 (2014); Agrotis, A. & Ketteler, R.,. *Front Genet* 6:300, each of which is hereby incorporated by reference in its entirety. Statistically-overrepresented nucleic acids may be determined using methods associated with pooled and arrayed screens (See Agrotis, A. & Ketteler, R. A new age in functional genomics using CRISPR/Cas9 in arrayed library screening. Front Genet 6, 300 (201S) hereby incorporated by reference in its entirety).

In a particular embodiment, a gene fragment library coding for potentially inhibitor peptides are synthesized via pooled oligonucleotide synthesis using solid-phase synthesis. Solid-phase synthesis is typically carried out on a solid support held between filters, in columns that enable all reagents and solvents to pass through freely. Solid-phase synthesis has a number of advantages over solution synthesis, including, large excesses of solution-phase reagents can be used to drive reactions quickly to completion; impurities and excess reagents are washed away and no purification may be required after each step; and the process is amenable to automation on computer-controlled solid-phase synthesizers. Solid supports (also called resins) are the insoluble particles, typically 50-200 μm in diameter, to which the oligonucleotide can be bound during synthesis. Many types of solid support have been used, but controlled pore glass (CPG) and polystyrene have proved to be the most useful.

The phosphoramidite method, pioneered by Marvin Caruthers in the early 1980s, and enhanced by the application of solid-phase technology and automation, is typically used. Phosphoramidite oligo synthesis proceeds in the 3'- to 5'-direction (opposite to the 5'- to 3'-direction of DNA biosynthesis in DNA replication). One nucleotide can be added per synthesis cycle. At the beginning of oligonucleotide synthesis, the first protected nucleoside can be pre-attached to the resin and the operator selects an A, G, C or T synthesis column depending on the nucleoside at the 3'-end of the desired oligonucleotide. The support-bound nucleoside has a 5'-DMT protecting group (DMT=4,4'-dimethoxytrityl), the role of which is to prevent polymerization during resin functionalization, and this protecting group must be removed (detritylation) from the support-bound nucleoside before oligonucleotide synthesis can proceed. Following detritylation, the support-bound nucleoside is ready to react with the next base, which can be added in the form of a nucleoside phosphoramidite monomer. A large excess of the appropriate nucleoside phosphoramidite can be mixed with an activator (tetrazole or a derivative), both of which are dissolved in acetonitrile (a good solvent for nucleophilic displacement reactions). The diisopropylamino group of the nucleoside phosphoramidite can be protonated by the activator, and can be thereby converted to a good leaving group. It can be rapidly displaced by attack of the 5'-hydroxyl group of the support-bound nucleoside on its neighboring phosphorus atom, and a new phosphorus-oxygen bond can be formed, creating a support-bound phosphite trimester. Nucleoside phosphoramidites are reasonably stable in an inert atmosphere and can be prepared in large quantities, shipped around the world and stored as dry solids for several months prior to use. Only upon protonation do nucleoside phosphoramidites become reactive.

It may not be unreasonable to expect a yield of 99.5% during each coupling step, but even with the most efficient chemistry and the purest reagents it may not be possible to achieve 100% reaction of the support-bound nucleoside with the incoming phosphoramidite. This means that there will be a few unreacted 5'-hydroxyl groups on the resin-bound nucleotide; if left unchecked, these 5'-hydroxyl groups would be available to partake in the next coupling step, reacting with the incoming phosphoramidite. The resulting oligonucleotide would lack one base. Deletion mutations are avoided by introducing a "capping" step after the coupling reaction, to block the unreacted 5'-hydroxyl groups. Two capping solutions are used on the synthesizer: acetic anhydride and N-methylimidazole (NMI). These two reagents (dissolved in tetrahydrofuran with the addition of a small quantity of pyridine) are mixed on the DNA synthesizer prior to delivery to the synthesis column. The electrophilic mixture rapidly acetylates alcohols, and the pyridine ensures that the pH remains basic to prevent detritylation of the nucleoside phosphoramidite by the acetic acid formed by reaction of acetic anhydride with NMI. Acetylation of the 5'-hydroxyl groups renders them inert to subsequent reactions.

After phosphoramidite coupling, capping and oxidation, the DMT protecting group at the 5'-end of the resin-bound DNA chain are removed so that the primary hydroxyl group can react with the next nucleotide phosphoramidite. Deprotection with trichloroacetic acid in dichloromethane can be rapid and quantitative. An orange color can be produced by cleaved DMT carbocation, which absorbs in the visible region at 495 nm. The intensity of this absorbance is used to determine the coupling efficiency. Most commercially available DNA synthesizers have hardware to measure and record the trityl yield for each cycle so that the efficiency of synthesis can be monitored in real time. The cycle can be repeated, once for each base, to produce the required oligonucleotide. The linker can be a chemical entity that attaches the 3'-end of the oligonucleotide to the solid support. It must be stable to all the reagents used in solid-phase oligonucleotide assembly, but cleavable under specific conditions at the end of the synthesis. The cleavage reaction can be carried out automatically on some synthesizers, and the ammoniacal solution containing the oligonucleotide can be delivered to a glass vial. Alternatively, the cleavage can be carried out manually by taking the column off the synthesizer and washing it with syringes containing ammonium hydroxide. The oligonucleotide, now dissolved in concentrated aqueous ammonia, can be heated to remove the protecting groups from the heterocyclic bases and phosphates. The aqueous solution can then removed by evaporation and the oligonucleotides are ready for purification.

Gene fragment libraries can be generated by splitting target gene(s) or relevant protein interaction partners into defined size fragments (e.g., 100 to 150 nt fragments). Several different commercial platforms exist for producing pooled oligonucleotides (e.g., CustomArray, Twist Bioscience, Agilent Technologies). Site directed mutagenesis can also be performed to optimize gene fragments for particular applications. Additionally, computational structure guided library design can be used to construct de novo gene fragment libraries which have predicted binding to target genes. The gene oligonucleotides are synthesized as gene fragment library which includes a plurality of gene fragments having more than 50, 100, 200, 300, 400, 500, 600, 700, 800, 1000, 1500, 2000, 5000, 10000 different sequences based from one or more target genes. Examples of target genes includes genes associated with a disease or disorder condition, such as oncogenes, or targets of infectious agents. The screening methodology of the disclosure can be agnostic to the disease model chosen. In theory, peptide inhibitors (drug-like peptides) of any protein target can be identified using the screening methods disclosed herein. The method can be assisted by having an in vitro assay to select for the phenotype of interest when contacted with a drug-like peptide. Alternatively, novel dominant negative inhibitors of protein function could be produced and sold as scientific reagents. Peptides across a wide size range (5-60 AA) can be screened via the screening methods disclosed herein, highlighting the broad utility of the screening methods of the disclosure as a platform technology.

In a particular embodiment, the gene fragments used in the screening methods disclosed herein are gene fragments of one or more oncogenes. Examples of oncogenes, include are but not limited to, MCL-1, BCR, BRAF, JAK1, JAK2, VEGF, EGFR, ALK, CDK1, CDK2, CDK3, CDK3, CDK4, BRCA, PIK3CA, MEK, C-KIT, NRAS, ABCB11, ANTXR2, BCOR, CDKN1B, CYP27A1, EMD, FANCF, ABCC8, APC, BCORL1, CDKN2A, CYP27B1, EP300, FANCG, ABCC9, AR, BLM, CEP290, DAXX, EPCAM, FANCI, ABCD1, ARID1A, BMPR1A, CFTR, DBT, EPHAS, FANCL, ABL1, ARID2, RAF1, CHEK1, DCC, EPHB2, FANCM, ACADM, ARSA, BRCA1, CHEK2, DCX, ERBB2, FAS, CADS, ASAH1, BRCA2, CHM, DDB2, ERBB3, FAT3, ACADVL, ASCC1, BRIP1, CIC, DDR2, ERBB4, FBXO11, ACTC1, ASL, BTD, CLN3, DES, ERCC2, FBXO32, ACTN2, ASPA, BTK, CLNS, DHCR7, ERCC3, FBXW7, ACVR1B, ASS1, BUB1B, CLN6, DICER1, ERCC4, FGD4, ADA, ASXL1, CALR3, CLN8, DIS3L2, ERCC5, FGFR1, ADAMTS13, ATM, CARD11, COL1A2, DKC1, ERCC6, FGFR2, ADAMTS2, ATP4A, CASP8, COL4A3, DLD, ERRFI1, FGFR3, AGA, ATP6V0D2, CAV3, COL4A4, DMD, ESCO2, FH, AGL, ATP7A, CBFB, COL7A1, DNAJB2, ESR1, FKTN, AGPS, ATP7B, CBL, COX15, DNMT3A, ETV6, FLCN, AHI1, ATP8B1, CBLB, CREBBP, DSC2, EXOC2, FLT3, AIP, ATR, CBLC, CRLF2, DSE, EXT1, FMR1, AKAP9, ATRX, CBS, CRTAP, DSC2, EXT2, FUBP1, AKT1, AXIN1, CCDC178, CRYAB, DSP, EYA4, FZD3, AKT2, AXIN2, CCNE1, CSF1R, DTNA, EZH2, G6PC, ALB, BAG3, CD79A, CSMD3, ECT2L, F11, GAA, ALDH3A2, BAI3, CD79B, CSRP3, EDA, F5, GABRA6, ALDOB, BAP1, CD96, CTNNB1, EDN3, FAH, GALNT12, ALK, BARD1, CDC27, CTNS, EDNRB, FAM46C, GALT, ALS2, BAX, CDC73, CTSK, EED, FANCA, GATA1, AMER1, BAZ2B, CDH1, CUBN, EGFR, FANCB, GATA2, AMPD1, BCKDHA, CDH23, CYLD, EGR2, FANCC, GATA3, AMPH, BCKDHB, CDK12, CYP11A1, EHBP1, FANCD2, GATAD1, ANTXR1, BCL6, CDK4, CYP21A2, ELMO1, FANCE, GBA, GCDH, JAK1, MDM2, NEK2, PLOD1, ROS1, SMPD1, GJB2, JAK2, MECP2, NEXN, PLP1, RPGRIP1L, SOX10, GLA, JAK3, MED12, NF1, PMP22, RS1, SOX2, GLB1, JUP, MEFV, NF2, PMS2, RSPO1, SPEG, GLI1, KAT6A, MEN1, NFE2L2, POLD1, RTEL1, SPOP, GLI3, KCNQ1, MET, NFKBIA, POLE, RUNX1, SRC, GLMN, KDM4B, MFSD8, NIPA2, POLH, RUNX1T1, SSTR1, GNA11, KDM6A, MIER3, NKX3-1, POMGNT1, RYR2, STAG2, GNAQ, KDR, MITF, NOTCH1, POMT1, S1PR2, STAR, GNAS, KEAP1, MKS1, NOTCH2, POU1F1, SAMD9L, STK11, GNPTAB, KIF1B, MLH1, NPC1, POU6F2, SBDS, SUFU, GPC3, KIT, MLH3, NPC2, PPM1L, SCN11A, SUZ12, GPC6, KLF6, MMAB, NPHP1, PPP2R1A, SCN5A, SYNE3, GPR78, KLHDC8B, MPL, NPHP4, PPT1, SCNN1A, TAZ, GRIN2A, KMT2A, MPZ, NPM1, PRDM1, SCNN1B, TBX20, GRM8, KMT2C, MRE11A, PRKAG2, SCNN1G, TCAP, GXYLT1, KMT2D, MSH2, NRCAM, PRKAR1A, SCO2, TCERG1, H3F3A, KRAS, MSH3, NTRK1, PRKDC, SDHA, TCF7L2, HADHA, KREMEN1, MSH6, NUP62, PROC, SDHAF2, TERT, HADHB, L1CAM, MSMB, OR5L1, PROP1, SDHB, TET2, HBB, LAMA2, MSR1, OTC, PRPF40B, SDHC, TFG, HESX1, LAMA4, MTAP, OTOP1, PRX, SDHD, TGFB3, HEXA, LAMP2, MTHFR, PAH, PSAP, SEPT9, TGFBR1, HEXB, LDB3, MTM1, PALB2, PSEN1, SETBP1, TGFBR2, HFE, LEPRE1, MTOR, PALLD, PSEN2, SETD2, THSD7B, HGSNAT, LIG4, MUC16, PAX5, PTCH1, SF1, TINF2, HIST1H3B, LMNA, MUT, PAX6, PTCH2, SF3A1, TMC6, HNF1A, LPAR2, MUTYH, PBRM1, PTEN, SF3B1, TMC8, HRAS, LRP1B, MYBPC3, PCDH15, PTGFR, SGCD, TMEM127, HSPH1, LRPPRC, MYC, PCGF2, PTPN11, SGSH, TMEM43, IDH1, LRRK2, MYD88, PDE11A, PTPN12, SH2B3, TMEM67, IDH2, LYST, MYH6, PDGFRA, RAC1, SLC25A4, TMPO, IGF2R, MAP2K1, MYH7, PDHA1, RAD21, SLC26A2, TNFAIP3, IGHMBP2, MAP2K2, MYL2, PDZRN3, RAD50, SLC37A4, TNFRSF14, IGSF10, MAP2K4, MYL3, PEX1, RAD51B, SLC7A8, TNNC1, IKBKAP, MAP3K1, MYLK2, PEX7, RAD51C, SLC9A9, TNNI3, IKZF1, MAP4K3, MYO1B, PHF6, RAD51D, SLX4, TNNT1, IKZF4, MAP7, MYO7A, PIK3CA, RARB, SMAD2, TNNT2, IL2RG, MAPK10, MYOZ2, PIK3CG, RB1, SMAD4, TP53, IL6ST, MAS1L, MYPN, PIK3R1, RBM20, SMARCA4, TPM1, IL7R, MAX, NBN, PKHD1, RECQL4, SMARCB1, TPP1, INVS, MC1R, NCOA2, PKP2, RET, SMC1A, TRAF5, IRAK4, MCCC2, NCOR1, PLEKHG5, RHBDF2, SMC3, TRIO, ITCH, MCOLN1, NDUFA13, PLN, RNASEL, SMO, TRPV4, TRRAP, U2AF1, USH1C, WAS, WWP1, ZIC3, TSC1, U2AF2, USH1G, WBSCR17, XPA, ZNF2, TSC2, UBA1, USP16, WEE1, XPC, ZNF226, TSHB, UBR3, USP25, WNK2, XRCC3, ZNF473, TSHR, UROD, VCL, WRN, ZBED4, ZNF595, TTN, UROS, VHL, WT1, ZFHX3, HER2, and ZRSR2. In a further embodiment, the oncogenes includes oncogenes selected from KRAS, HRAS, NRAS, RAF1, BRAF, ARAF, Myc, Max, FBXW7, and EGFR. In another embodiment, the gene fragments used in the screening methods disclosed herein are gene fragments of one or more receptors used as ligands for viruses. Examples of such receptor, include but are not limited to, CD4, poliovirus receptor, ICAM-1, Integrin (VLA-2), Coxsackievirus-adenovirus receptor (CAR), HAVcr-1, VACM-1, laminin receptor, angiotensin-converting enzyme 1 or 2 (ACE-1 or -2), MCP (CD46), SLAM, nectin-1, nectin-2, TNFR family, dipeptidyl peptidase-4 or -8 or -9, and CD21. The sequences of the oncogene/oncoproteins identified herein and above as well as the receptor identified herein have sequences that are known, as well as characterized biological activity. For example, AKT1 encodes RAC-alpha serine/threonine-protein kinase. This enzyme belongs to the AKT subfamily of serine/threonine kinases that contain SH2 (Src homology 2-like) domains. In some cases, it is commonly referred to as PKB, or by both names as "Akt/PKB". AKT1 was originally identified as the oncogene in the transforming retrovirus, AKT8. In some cases, "BRAF" is a human gene that encodes a protein called B-Raf. The gene can also be referred to as proto-oncogene B-Raf and v-Raf murine sarcoma viral oncogene homolog B, while the protein can be more formally known as serine/threonine-protein kinase B-Raf. In some cases, the B-Raf protein is involved in sending signals inside cells which are involved in directing cell growth. In some cases, the mammalian target of rapamycin (mTOR), sometimes also referred to as the mechanistic target of rapamycin and FK506-binding protein 12-rapamycin-associated protein 1 (FRAP1), is a kinase that in humans is encoded by the MTOR gene. mTOR is a member of the phosphatidylinositol 3-kinase-related kinase family of protein kinases. mTOR links with other proteins and serves as a core component of two distinct protein complexes, mTOR complex 1 and mTOR complex 2, which regulate different cellular processes. In particular, as a core component of both complexes, mTOR functions as a serine/threonine protein kinase that regulates cell growth, cell proliferation, cell motility, cell survival, protein synthesis, autophagy, and transcription. mTOR also functions as a tyrosine protein kinase that promotes the activation of insulin receptors and insulin-like growth factor 1 receptors. Over-activation of mTOR signaling significantly contributes to the initiation and development of tumors and mTOR activity was found to be deregulated in many types of cancer including breast, prostate, lung, melanoma, bladder, brain, and renal carcinomas. Various oncogenes and receptors coding sequence as well as the expressed polypeptides are described in Table 1.

Once synthesized, oligonucleotides are cloned into the appropriate vector for the biological model and planned screening study. In a particular embodiment, the gene fragments are packaged into viral vectors for delivery of gene fragments to target cells for overexpression. Viral vectors are introduced at a low multiplicity of infection (MOI) in order to ensure that cells receive only a single gene fragment from the library pool. Examples of viral vectors, include, but are not limited to, recombinant retroviral vectors, adenoviral vectors, adeno-associated viral vector, alphaviral vectors, and lentiviral vectors. In a particular embodiment, the viral vector is a lentiviral vector. Because lentiviruses integrate into the genome, the viral integrant serves as a tag for readout of which sgRNA construct can be delivered to a particular cell. Lentivirus is unique in its ability to infect non-dividing cells, and therefore has a wider range of potential applications. In some cases, the lentiviral genome in the form of RNA is reverse-transcribed when the virus enters the cell to produce DNA, which is then inserted into the genome at a position determined by the viral integrase enzyme. For safety reasons lentiviral vectors never carry the genes required for their replication.

In another embodiment, the viral vector is an adeno-associated virus (AAV). AAV is a tiny non-enveloped virus having a 25 nm capsid. In some cases, no disease is known or has been shown to be associated with the wild type virus. AAV has a single-stranded DNA (ssDNA) genome. AAV has been shown to exhibit long-term episomal transgene expression, and AAV has demonstrated excellent transgene expression in the brain, particularly in neurons. Vectors containing as little as 300 base pairs of AAV can be packaged and can integrate. Space for exogenous DNA can be limited to about 4.7 kb. An AAV vector such as that described in Tratschin et al., *Mol. Cell. Biol.* 5:3251-3260 (1985) can be used to introduce DNA into cells. A variety of nucleic acids have been introduced into different cell types using AAV vectors (see for example Hermonat et al., *Proc. Natl. Acad. Sci. USA* 81:6466-6470 (1984); Tratschin et al., *Mol. Cell. Biol.* 4:2072-2081 (1985); Wondisford et al., *Mol. Endocrinol.* 2:32-39 (1988); Tratschin et al., *J. Virol.* 51:611-.619 (1984); and Flotte et al., *J. Biol. Chem.* 268:3781-.3790 (1993). There are numerous alternative AAV variants (over 100 have been cloned), and AAV variants have been identified based on desirable characteristics. For example, AAV9 has been shown to efficiently cross the blood-brain barrier. Moreover, the AAV capsid can be genetically engineered to increase transduction efficient and selectivity, e.g., biotinylated AAV vectors, directed molecular evolution, self-complementary AAV genomes and so on. Modified AAV have also been described, including AAV based on ancestral sequences; see, e.g., U.S. Pat. No. 7,906,111; WO/2005/033321; WO2008/027084, WO2014/124282; WO2015/054653; and WO2007/127264. Other modified AAVs that have been described include chimeric nanoparticles (ChNPs) that have an AAV core that expresses a transgene that is surrounded by layer(s) of acid labile polymers that have embedded antisense oligonucleotides (e.g., see Hong et al., ACS Nano 10:8705-8716 (2016)) and Cho et al., *Biomaterials* 2012, 33, 3316-3323). The compositions and methods disclosed herein, in some embodiments, provide a platform technology, and as such the composition and methods disclosed herein can be used with all known AAVs, including the modified AAVs described in the literature, such as ChNPs.

Alternatively, retrovirus vectors and adeno-associated viral vectors can be used as a recombinant gene delivery system for the transfer of gene fragments. These vectors provide efficient delivery of genes into cells, and the transferred nucleic acids are stably integrated into the chromosomal DNA of the host. The development of specialized cell lines (termed "packaging cells") which produce only replication-defective retroviruses has increased the utility of retroviruses for viral gene therapy, and defective retroviruses are characterized for use in gene transfer for viral gene therapy purposes (for a review see Miller, *Blood* 76:271 (1990)). A replication defective retrovirus can be packaged into virions, which can be used to infect a target cell through the use of a helper virus by standard techniques. Protocols for producing recombinant retroviruses and for infecting cells in vitro or in vivo with such viruses can be found in Ausubel, et al, eds., Current Protocols in Molecular Biology, Greene Publishing Associates, (1989), Sections 9.10-9.14, and other standard laboratory manuals. Examples of suitable retroviruses include pLJ, pZIP, pWE and pEM which are known to those skilled in the art. Examples of suitable packaging virus lines for preparing both ecotropic and amphotropic retroviral systems include Ψ& ιρ, Ψ&ε, Ψ2 and ΨΑΠι. Retroviruses have been used to introduce a variety of genes into many different cell types, including epithelial cells, in vitro and/or in vivo (see for example Eglitis, et al. (1985) *Science* 230: 1395-1398; Danos and Mulligan (1988) *Proc. Natl. Acad. Sci. USA* 85:6460-6464; Wilson et al. (1988) *Proc. Natl. Acad. Sci. USA* 85:3014-3018; Armentano et al. (1990) *Proc. Natl. Acad. Sci. USA* 87:6141-6145; Huber et al. (1991) *Proc. Natl. Acad. Sci. USA* 88:8039-8043; Ferry et al. (1991) *Proc. Natl. Acad. Sci. USA* 88:8377-8381; Chowdhury et al. (1991) *Science* 254: 1802-1805; van Beusechem et al. (1992) *Proc. Natl. Acad. Sci. USA* 89:7640-7644; Kay et al. (1992) *Human Gene Therapy* 3:641-647; Dai et al. (1992) *Proc. Natl. Acad. Sci. USA* 89: 10892-10895; Hwu et al. (1993) *J. Immunol.* 150:4104-4115; U.S. Pat. Nos. 4,868,116; 4,980,286; PCT Application WO 89/07136; PCT Application WO 89/02468; PCT Application WO 89/05345; and PCT Application WO 92/07573).

Another viral gene delivery system useful in the methods of the disclosure utilizes adenovirus-derived vectors. The genome of an adenovirus can be manipulated, such that it encodes and expresses a gene product of interest but is inactivated in terms of its ability to replicate in a normal lytic viral life cycle. See, for example, Berkner et al., *BioTechniques* 6:616 (1988); Rosenfeld et al., Science 252:431-434 (1991); and Rosenfeld et al., *Cell* 68: 143-155 (1992). Suitable adenoviral vectors derived from the adenovirus strain Ad type 5 d1324 or other strains of adenovirus (e.g., Ad2, Ad3, or Ad7 etc.) are known to those skilled in the art. Recombinant adenoviruses can be advantageous in certain circumstances, in that they are not capable of infecting non-dividing cells and can be used to infect a wide variety of cell types, including epithelial cells (Rosenfeld et al., (1992) supra). Furthermore, the virus particle can be relatively stable and amenable to purification and concentration, and as above, can be modified so as to affect the spectrum of infectivity. Additionally, in some cases, introduced adenoviral DNA (and foreign DNA contained therein) is not integrated into the genome of a host cell but remains episomal, thereby avoiding potential problems that can occur as a result of insertional mutagenesis in situ, where introduced DNA becomes integrated into the host genome (e.g., retroviral DNA). Moreover, the carrying capacity of the adenoviral genome for foreign DNA can be large (up to 8 kilobases) relative to other gene delivery vectors (Berkner et al., supra; Haj-Ahmand and Graham, J. Virol. 57:267 (1986). Alphaviruses can also be used.

Alphaviruses are enveloped single stranded RNA viruses that have a broad host range, and when used in the methods disclosed herein alphaviruses can provide high-level transient gene fragment expression. Exemplary alphaviruses include the Semliki Forest virus (SFV), Sindbis virus (SIN) and Venezuelan Equine Encephalitis (VEE) virus, all of which have been genetically engineered to provide efficient replication-deficient and -competent expression vectors. Alphaviruses exhibit significant neurotropism, and so are useful for CNS-related diseases. See, e.g., Lundstrom, Viruses. 2009 June; 1(1): 13-25; Lundstrom, Viruses. 2014 June; 6(6): 2392-2415; Lundstrom, *Curr Gene Ther.* 2001 May; 1(1): 19-29; Rayner et al., Rev Med Virol. 2002 September-October; 12(5):279-96.

Gamma-retroviral vectors (replication competent or defective) can also be used (e.g., MLV). Typical constructs include viruses with a viral genome comprising viral genes (e.g., gag, pol, env) having an expression cassette located in the LTRs or downstream of the envelope gene.

The frequency of observing any particular tag (gene fragment) before and after phenotypic selection can be a parameter measured using the screening methods disclosed herein. After cloning, the distribution of cloned oligos in the pooled library can be assessed using Next-Generation Sequencing (NGS). In some cases, high throughput sequencing is then used to track the abundance of each gene fragment as the target cells grow. Gene fragments which significantly deplete over the course of cell growth are deleterious to cell fitness and can then be synthesized individually to measure their performance in additional assays, such as cell proliferation, RNA-Seq, Mass Spec, etc.

As exemplified in the studies presented herein, the screening methodology of the disclosure allowed for the identification of highly effective dominant negative inhibitors of oncogene mediated cancer cell proliferation and viral entry. Because the library of gene fragments can be user defined and custom synthesized, the screening methods disclosed herein are easily adaptable to diverse projects where a selection strategy can be devised to enrich or deplete cells with the phenotype of interest. Technologies which can partition cells based on unique phenotypic features such as Flow Activated Cell Sorting (FACS), or magnetic bead pull down will play a key role in expanding this methodology beyond proliferation. This combined with the decreasing cost of single cell RNA sequencing allows for investigation of increasingly more complex phenotypes, such as cellular differentiation and regeneration. Dominant negative peptides have immense potential as both research tools and therapeutics. Direct inhibition of protein activity without genetic alteration opens unique screening avenues with which to probe protein function. For example, one of the dominant negative fragments identified in the studies presented herein appears selective to a specific KRAS mutation, potentially allowing for mutant allele specific inhibition in a functional screen. Furthermore, with minimal engineering, a dominant negative peptide EGFR inhibitor opposed TNBC cell growth in vitro as effectively as FDA approved small molecules. Because one of the key limitations of dominant negative peptide inhibitors can be the intracellular location of the target proteins, it is expected that advances in biologics delivery can improve the translational relevance this strategy.

In concert with direct oncological applications, the screening methodologies disclosed herein could be potentially used to identify peptides which are immunostimulatory/immunosuppressive via FACS based screening of immune effector cells. The design of the experiment could be tailored specifically to the pathogenic context (e.g., screening in regulatory T cells to identify immunosuppressive peptides to treat autoimmune disorders). Furthermore, the screening methodologies disclosed herein could also be adapted to inhibiting pathogenic protein-protein interactions directly, such as neurodegenerative tauopathies.

As such, the disclosure further provides the following applications which can utilize the screening methodologies described herein, including, but not limited to, profiling MHC binding peptides; disrupting pathogenic protein aggregation relevant to tauopathies, amyloid plaques etc.; cytokine/receptor engineering or profiling relevant to cancer immunotherapy as well as autoimmune disorders; identifying peptides mediating regenerative phenotypes such as angiogenesis; discovering anti-aging therapeutics; and discovering pain modulating peptides.

The disclosure provides a number of drug-like peptides in the accompanying sequence listing (incorporated herein by reference) that can have biological activity in various cancer and disease models. The disclosure thus provides peptides comprising, consisting essentially of or consisting of sequences that are at least 85, 87, 90, 92, 94, 95, 98, 99 or 100% identical to any one of the sequences set forth in the accompanying sequence listing at SEQ ID NOs:1-9488 or 9489). Moreover, it should be recognized that the peptides of the disclosure can have 1-30 additional amino acids appended to the N- or C-terminal end of the peptide (e.g., CPPs, linkers, purification sequences etc.). These drug-like peptide can be delivered to a subject or cell to treat cancer or disease progression by inhibiting the biological activity of the corresponding full length polypeptide from which the peptides are derived. For example, two drug-like peptides (RAF1_73 and EGFR_697) are exemplified that opposed triple-negative breast cancer cell growth in vitro as effectively as some FDA approved small molecules. Because peptide drugs are often limited by the intracellular location of the target proteins, advances in biologics delivery will drastically improve the translational relevance of this strategy.

The disclosure provides drug-like peptides (e.g., dominant negative peptides) as set forth in Table 1. The dominant negative peptides can be used to treat cell proliferative disorders (e.g., such as those in the same row as the peptide sequence) where the cell proliferative disorder can be caused by or associated with the biological activity of the gene product.

TABLE 1

| Parental Gene/Protein Name | Exemplary Disease/Disorder/Cancer | Parental (SEQ ID NO) * | Drug-like peptides (SEQ ID NOs) |
|---|---|---|---|
| AKT1 (synonyms: PKB-ALPHA, RAC, PRKBA, PKB, RAC-ALPHA, CWS 6) | ductal carcinoma, lung adenocarcinoma, colon adenocarcinoma, endometrial endometrioid adenocarcinoma, and invasive breast carcinoma | 9540 | 1-5, 5000-5010 |
| AR (androgen receptor; synonyms: KD, NR3C4, DHTR, AR8, HYSP1, TFM, AIS, SMAX1, SBMA, HUMARA) | prostate adenocarcinoma, lung adenocarcinoma, colon adenocarcinoma, endometrial endometrioid adenocarcinoma, and breast invasive ductal carcinoma | 9542 | 3499, 3750-3759, 5011-5073 |
| ARAF (synonyms: RAFA1, A-RAF, ARAF1, PKS2) | lung adenocarcinoma, colon adenocarcinoma, endometrial endometrioid adenocarcinoma, breast invasive | 9544 | 5074-5084 |

TABLE 1-continued

| Parental Gene/Protein Name | Exemplary Disease/Disorder/Cancer | Parental (SEQ ID NO) * | Drug-like peptides (SEQ ID NOs) |
|---|---|---|---|
| | ductal carcinoma, and high grade ovarian serous adenocarcinoma | | |
| BRAF (synonyms: RAFB1, BRAF1, NS7, B-raf, B-RAF1) | colon adenocarcinoma, cutaneous melanoma, lung adenocarcinoma, melanoma, and thyroid gland papillary carcinoma, colorectal adenocarcinoma, breast invasive ductal carcinoma, melanoma, prostate adenocarcinoma | 9546 | 6-15, 350-489, 2555-2586, 2949-2974, 3500-3509, 3760-3792, 5086-5185 |
| CASP8 | Breast and ovarian cancer | 9548 | 490-498, 2587-2588, 2975-2981, 3511, 3793-3804, 5186-5228 |
| CCND1 (synonyms: BCL1, D11S287E, U21B31, PRAD1) | breast invasive ductal carcinoma, invasive breast carcinoma, bladder urothelial carcinoma, breast invasive lobular carcinoma, and lung adenocarcinoma | 9550 | 5229-5250 |
| CDH1 (cadherin-1; synonyms: CAM120/80, E-cadherin, uvomorulin) | lobular breast carcinoma | 9552 | 499-514, 2589-2591, 2982, 3511, 3805-3816, 5251-5310 |
| CDKN2A (cyclin-dependent kinase inhibitor 2A; synonyms: MLM, P19, CDK4I, MTS1, P19ARF, CDKN2, P16, CMM2, P14, TP16, P16INK4A, P16INK4, ARF, MTS-1, INK4, INK4A, P16-INK4A, P14ARF) | lung adenocarcinoma, conventional glioblastoma multiforme, pancreatic adenocarcinoma, cutaneous melanoma, and bladder urothelial carcinoma | 9554 | 515-517 |
| CHEK2 (checkpoint kinase 2; synonyms: CDS1, CHK2, LFS2, RAD53, hCds1, HuCds1, PP1425) | Breast cancer, ovarian cancer, colorectal cancer, prostate cancer, thyroid cancer, osteosarcoma | 9556 | 518-592, 2592-2609, 2983-3009, 3443-3444, 3512-3514, 3817-3859, 5311-5450 |
| CTNNB1 (catenin beta-1; synonyms: armadillo, EVR7, CTNNB, MRD19) | lung adenocarcinoma, endometrial endometrioid adenocarcinoma, colon adenocarcinoma, hepatocellular carcinoma, and prostate adenocarcinoma | 9558 | 16-27, 593-636, 2610-2629, 3010-3039, 3860-3862, 5451-5502 |
| DDX3X (DEAD-box helicase 3 X-linked; synonyms: DBX, DDX3, HLP2, DDX14, CAP-Rf, MRX102) | Liver cancer, medulloblastoma | 9560 | 637-645, 2630-2634, 3040-3042, 3863-3878, 5503-5582 |
| DICER1 (synonyms: DCR1, GLOW, MNG1, Dicer, HERNA, RMSE2, Dicerle, K12H4.8-LIKE) | Ovarian cancer, lung cancer, testicular cancer, thyroid cancer, Wilms tumour, stomach cancer, bladder cancer, skin cancer, lung cancer, eye cancer | 9562 | 28-32, 646-671, 2635-2639, 3043-3059, 3445-3447, 3515-3532, 3879-3941, 5583-5863 |
| EGFR (epithelial growth factor receptor; synonyms: ERBB, HER1, mENA, NISBD2, PIG61, ERBB1) | lung adenocarcinoma, conventional glioblastoma multiforme, breast invasive ductal carcinoma, glioblastoma, and colon adenocarcinoma | 9564 | 33-49, 672-725, 2640-2655, 3060-3082, 3448, 3533-3536, 3942-3973, 5864-5934 |
| EP300 (histone acetyltransferase p300; synonyms: KAT3B, RSTS2, p300) | lung adenocarcinoma, colon adenocarcinoma, bladder urothelial carcinoma, breast invasive ductal carcinoma, and endometrial endometrioid adenocarcinoma | 9566 | 50-59, 726-736, 2656-2660, 3083-3105 |
| ERBB2 (receptor tyrosine-protein kinase erbB-2; synonyms: HER-2, CD340, NEU, “MLN 19”, NGL, TKR1, HER-2/neu, HER2) | breast invasive ductal carcinoma, lung adenocarcinoma, colon adenocarcinoma, bladder urothelial carcinoma, and invasive breast carcinoma | 9568 | 60, 737-742, 2661-2662, 3106-3107, 3537-3538, 3974-3985, 5935-5980 |
| ERBB3 (receptor tyrosine-protein kinase erbB-3; synonyms: erbB3-S, LCCS2, p85-sErbB3, c-erbB3, HER3, MDA-BF-1, p180-ErbB3, ErbB-3, c-erbB-3, p45-sErbB3) | colon adenocarcinoma, breast invasive ductal carcinoma, bladder urothelial carcinoma, lung adenocarcinoma, and endometrial endometrioid adenocarcinoma | 9570 | 743-745, 3539-3544, 3986-3998, 5981-6064 |
| ERBB4 (ERBB4 intracellular domain; synonyms: p180erbB4, ALS19, HER4) | lung adenocarcinoma, colon adenocarcinoma, cutaneous melanoma, melanoma, and breast invasive ductal carcinoma | 9572 | 746-751, 2663, 3108-3110, 3449-3451, 3545-3548, 3999-4047, 6065-6180 |

TABLE 1-continued

| Parental Gene/Protein Name | Exemplary Disease/Disorder/Cancer | Parental (SEQ ID NO) * | Drug-like peptides (SEQ ID NOs) |
|---|---|---|---|
| FBXW7 (F-box/WD repeat-containing protein 7; synonyms: SEL-10, FEW6, hAgo, CDC4, FBX30, FBW7, FBXO30, hCdc4, SEL10, FBXW6, AGO) | colon adenocarcinoma, rectal adenocarcinoma, lung adenocarcinoma, colorectal adenocarcinoma, and endometrial endometrioid adenocarcinoma | 9574 | 752-812, 2664-2668, 3111-3125, 3549, 4048-4061, 6181-6251 |
| FGFR2 (fibroblast growth factor receptor 2; synonyms: BEK, CFD1, TK25, KGFR, BBDS, TK14, BFR-1, JWS, CEK3, K-SAM, ECT1, CD332) | endometrial endometrioid adenocarcinoma, breast invasive ductal carcinoma, colon adenocarcinoma, lung adenocarcinoma, and cutaneous melanoma | 9576 | 813-819, 2669-2671, 3126-3130, 4062-4075, 6252-6310 |
| FGFR3 (fibroblast growth factor receptor 3; synonyms: CD333, HSFGFR3EX, JTK4, CEK2, ACH) | bladder urothelial carcinoma, colon adenocarcinoma, lung adenocarcinoma, breast invasive ductal carcinoma, and infiltrating renal pelvis and ureter urothelial carcinoma | 9578 | 820-824, 6311-6323 |
| FLT3 (receptor-type tyrosine-protein kinase FLT3; synonyms: FLK-2, FLK2, CD135, STK1) | colon adenocarcinoma, acute myeloid leukemia, lung adenocarcinoma, breast invasive ductal carcinoma, and cutaneous melanoma | 9580 | 825-855, 2672-2678, 3131, 3550-3572, 4076-4106, 6324-6471 |
| GFP | | 9582 | 856-858 |
| GNA11 (guanine nucleotide-bindign protein subunit alpha-11; synonyms: FBH, GNA-11, FBH2, HYPOC2, HHC2, FHH2) | uveal melanoma, colon adenocarcinoma, lung adenocarcinoma, breast invasive ductal carcinoma, and high grade ovarian serous adenocarcinoma | 9584 | 859-863, 3132, 4107, 6472-6481 |
| GNAQ (guanine nucleotide-bindign protein G (q) subunit alpha; synonyms: GAQ, G-ALPHA-q, CMC1, SWS) | uveal melanoma, lung adenocarcinoma, colon adenocarcinoma, melanoma, and bladder urothelial carcinoma | 9586 | 61-63, 864-866, 2679-2682, 3133-3136, 6482-6510, |
| HPRT1 (hypoxanthine-guanine phosphoribosyltransferase; synonyms: HPRT, HGPRT) | Skin cancer, bladder cancer, cervical cancer, Wilms Tumour | 9588 | 64-65, 867-875, 2683, 3137-3146, 4108, 6511-6525, |
| HRAS (GTPase HRas, N-terminally processed; synonyms: HRAS1, C-H-RAS, C-BAS/HAS, H-RASIDX, CTLO, RASH1, p21ras, HAMSV, C-HA-RAS1) | bladder urothelial carcinoma, myelodysplastic syndromes, breast invasive ductal carcinoma, acute myeloid leukemia, and lung adenocarcinoma | 9590 | 876-894, 2684, 3147-3149, 6526-6527, |
| IDH1 (isocitrate dehydrogenase (NADP) cytoplasmic; synonyms: IDP, IDCD, HEL-216, IDE, HEL-S-26, PICD, IDPC) | oligodendroglioma, anaplastic astrocytoma, astrocytoma, acute myeloid leukemia, and conventional glioblastoma multiforme | 9592 | 895-905, 3150-3152, 4109, 6528-6557 |
| IDH2 (isocitrate dehydrogenase (NADP), mitochondrial; synonyms: IDP, IDEM, IDE, ICD-M, mNADP-IDH, IDPM, D2HGA2) | acute myeloid leukemia, breast invasive ductal carcinoma, colon adenocarcinoma, lung adenocarcinoma, and myelodysplastic syndromes | 9594 | 66-69, 899-905, 4110-4111, 6558-6571 |
| KEAP1 (Kelch-like ECH-associated protein 1; synonyms: INrf2, KLHL19) | lung adenocarcinoma, squamous cell lung carcinoma, non-small cell lung carcinoma, cancer of unknown primary, and colon adenocarcinoma | 9596 | 906-921, 2685, 3153-3156, 4112, 6572-6582 |
| KIT (mast/stem cell growth factor receptor Kit; synonyms: SCFR, C-Kit, MASTC, PBT, CD117) | gastrointestinal stromal tumor, lung adenocarcinoma, colon adenocarcinoma, conventional glioblastoma multiforme, and melanoma | 9598 | 70-73, 922-950, 2686-2703, 3157-3184, 3573-3574, 4113-4127, 6583-6707 |
| KMT2C (histone-lysine N-methyltransferase 2C; synonyms: HALR, KLEFS2, MLL3) | breast invasive ductal carcinoma, lung adenocarcinoma, colon adenocarcinoma, prostate adenocarcinoma, and cutaneous melanoma | 9600 | 951-961, 3185 |
| KRAS (MAP kinase signaling) | lung adenocarcinoma, colon adenocarcinoma, pancreatic adenocarcinoma, colorectal adenocarcinoma, and rectal adenocarcinoma | 9602 | 962-1052, 2704-2721, 3186-3198, 3452, 3575-3579, 4128-4158, 6708-6753 |

TABLE 1-continued

| Parental Gene/Protein Name | Exemplary Disease/Disorder/Cancer | Parental (SEQ ID NO) * | Drug-like peptides (SEQ ID NOs) |
|---|---|---|---|
| KRAS4B (MAP kinase signaling 4B) | lung adenocarcinoma, colon adenocarcinoma, pancreatic adenocarcinoma, colorectal adenocarcinoma, and rectal adenocarcinoma | 9604 | 4159-4167, 6754-6805 |
| MAP2K1 (dual specificity mitgen-activated protein kinase kinase 1; synonyms: MAPKK1, PRKMK1, CFC3, MEK1, MKK1) | cutaneous melanoma, colon adenocarcinoma, lung adenocarcinoma, bladder urothelial carcinoma, and breast invasive ductal carcinoma | 9606 | 74, 1053-1059, 2722, 3199-3202, 3580, 4168-4180, 6806-6848 |
| MAX (MYC associated factor X) | Colorectal cancer, breast cancer, prostate cancer, lung cancer, liver cancer | 9608 | 6849-6851 |
| MDM2 (E3 ubiquitin-protien ligase Mdm2; synonyms: HDMX, ACTFS, hdm2) | lung adenocarcinoma, breast invasive ductal carcinoma, dedifferentiated liposarcoma, bladder urothelial carcinoma, and conventional glioblastoma multiforme | 9610 | 3453-3455, 3581-3588, 4181-4221, 6852-6939 |
| MDM4 (synonyms: HDMX, MRP1, MDMX) | breast invasive ductal carcinoma, lung adenocarcinoma, conventional glioblastoma multiforme, glioblastoma, and prostate adenocarcinoma | 9612 | 3589-3595, 4222-4262, 6940-7052 |
| MET (hepatocyte growth factor receptor; synonyms: c-Met, DFNB97, RCCP2, HGFR, AUTS9) | lung adenocarcinoma, colon adenocarcinoma, cutaneous melanoma, melanoma, and conventional glioblastoma multiforme | 9614 | 75, 1060-1071, 2723-2729, 3203-3216, 3456-3457, 3596-3600, 4263-4297, 7053-7273 |
| MTOR (serine/threonine-protein kinase mTOR; synonyms: RAPT1, FRAP2, FRAP, FRAP1, RAFT1, SKS) | lung adenocarcinoma, colon adenocarcinoma, endometrial endometrioid adenocarcinoma, breast invasive ductal carcinoma, and bladder urothelial carcinoma | 9616 | 76-77, 1072-1080, 3458, 3601, 4298-4311, 7274-7379 |
| MYC (Myc prot-oncogene protein; synonyms: MRTL, MYCC, bHLHe39, c-Myc) | breast invasive ductal carcinoma, lung adenocarcinoma, prostate adenocarcinoma, colon adenocarcinoma, and high grade ovarian serous adenocarcinoma | 9618 | 4312-4317, 7380-7409 |
| MYCL (synonyms: bHLHe38, LMYC, L-Myc, MYCL1) | bladder urothelial carcinoma, breast invasive ductal carcinoma, high grade ovarian serous adenocarcinoma, small cell lung carcinoma, and lung adenocarcinoma | 9620 | 4318, 7410-7426 |
| MYCN (N-myc proto-oncogene protein; synonyms: N-myc, ODED, MODED, bHLHe37, NMYC) | neuroblastoma, conventional glioblastoma multiforme, breast invasive ductal carcinoma, bladder urothelial carcinoma, and anaplastic astrocytoma | 9622 | 3602, 4319-4327, 7427-7453 |
| NCOA3 (nuclear receptor coactivator 3) | breast invasive ductal carcinoma, colon adenocarcinoma, rectal adenocarcinoma, lung adenocarcinoma, and mixed lobular and ductal breast carcinoma | 9624 | 3603, 4328-4378, 7454-7618 |
| NFE2L2 (nuclear factor erythroid 2-related factor 2; synonyms: HEBP1, NRF2, IMDDHH) | squamous cell lung carcinoma, lung adenocarcinoma, endometrial endometrioid adenocarcinoma, bladder urothelial carcinoma, and colon adenocarcinoma | 9626 | 1081-1183, 2730-2740, 3217-3221, 3459-3460, 3604-3634, 4379-4430, 7619-7694 |
| NKX2 | Lung cancer, adenocarcinomas, thyroid cancer | 9628 | 4431-4435, 7695-7712 |
| NOTCH1 (synonyms: AOVD1, TAN1, AOS5, hN1) | colon adenocarcinoma, lung adenocarcinoma, breast invasive ductal carcinoma, endometrial endometrioid adenocarcinoma, and bladder urothelial carcinoma | 9630 | 1184-1187, 4436, 7713-7752 |
| NRAS (GTPase NRas; synonyms: ALPS4, NRAS1, NS6, CMNS, NCMS, N-ras) | cutaneous melanoma, melanoma, colon adenocarcinoma, acute myeloid leukemia, and lung adenocarcinoma | 9632 | 1188-1197, 2741-2747, 3222-3225, 4437-4444, 7753-7771 |
| OMOMYC (dominant negative of Myc) | breast invasive ductal carcinoma, lung adenocarcinoma, prostate adenocarcinoma, colon adenocarcinoma, and high grade ovarian serous adenocarcinoma | 9634 | 4445-4447, 7772-7782 |

TABLE 1-continued

| Parental Gene/Protein Name | Exemplary Disease/Disorder/Cancer | Parental (SEQ ID NO) * | Drug-like peptides (SEQ ID NOs) |
|---|---|---|---|
| PIK3CA (Phosphatidylinositol 4,5-bisphosphate 3-kinase catalytic subunit alpha isoform; Synonyms: PI3K, MCM, p110-alpha, MCAP, CLOVE, MCMTC, PI3K-alpha, CWS5) | breast invasive ductal carcinoma, colon adenocarcinoma, lung adenocarcinoma, endometrial endometrioid adenocarcinoma, and breast invasive lobular carcinoma | 9636 | 78-111, 1198-1273, 2748-2788, 3226-3254, 3461-3463, 3635-3650, 4448-4565, 7783-8035 |
| PIK3R1 (phosphatidylinositol 3-kinase regulatory subunit alpha; synonyms: IMD36, AGM7, GRB1, p85-ALPHA, p85) | endometrial endometrioid adenocarcinoma, colon adenocarcinoma, breast invasive ductal carcinoma, conventional glioblastoma multiforme, and lung adenocarcinoma | 9638 | 112-151, 1274-1308, 2789-2825, 3255-3279, 3651-3655, 4566-4608, 8036-8180 |
| PPP2R1A (Serine/threonine-protein phosphatase 2A 65 kDa regulatory subunit A alpha isoform; synonyms: MRD36, PP2A-Aalpha, PP2AA, PP2AAALPHA, PR65A) | endometrial serous adenocarcinoma, breast invasive ductal carcinoma, colon adenocarcinoma, lung adenocarcinoma, and endometrial endometrioid adenocarcinoma | 9640 | 152-153, 1309-1329, 2826, 3280-3287, 3656, 8181-8201 |
| PTPN11 (Tyrosine-protein phosphatase non-receptor type 11; synonyms: SH-PTP3, JMML, SHP2, PTP-1D, BPTP3, CFC, NS1, SH-PTP2, PTP2C, METCDS) | acute myeloid leukemia, lung adenocarcinoma, conventional glioblastoma multiforme, colon adenocarcinoma, and glioblastoma | 9642 | 154-171, 1330-1385, 2827-2840, 3288-3301, 3464, 3657, 4609-4626, 8202-8310 |
| RAB25 (Ras-related protein 25) | Breast cancer, colorectal adenocarcinoma and esophageal cancer | 9644 | 4627, 8311-8313 |
| RAC1 (Ras-related C3 botulinum toxin substrate 1) | Melanoma and non-small cell lung cancer | 9646 | 172, 1386-1412, 2841-2845, 3302-3313, 3658-3661, 4628-4640, 8314-8339 |
| RAF1 (RAF proto-oncogene serine/threonine-protein kinase; synonyms: Raf-1, C-Raf, NS5, CMD1NN, CRAF) | colon adenocarcinoma, bladder urothelial carcinoma, lung adenocarcinoma, cutaneous melanoma, and breast invasive ductal carcinoma | 9648 | 3465-3467, 4641-4654, 8340-8403 |
| RASA1 (RAS p21 protein activator 1) | Basal cell carcnoma | 9650 | 1413-1417, 3314, 3468-3491, 3662-3674, 4655-4738, 8404-8620 |
| RB1 (retinoblastoma-associated protein; synonyms: PPP1R130, pRb, OSRC, RB, p105-Rb, pp110) | lung adenocarcinoma, breast invasive ductal carcinoma, small cell lung carcinoma, bladder urothelial carcinoma, and colon adenocarcinoma | 9652 | 1418-1424, 2846-2856, 3315-3321, 3492-3494, 3675-3713, 4739-4823, 8621-8861 |
| RHEB (GTP-bindign protein Rheb; RHEB2) | lung adenocarcinoma, colon adenocarcinoma, breast invasive ductal carcinoma, prostate adenocarcinoma, and endometrial endometrioid adenocarcinoma | 9654 | 1425-1432, 2857-2858, 3322-3329, 4824-4829, 8862-8901 |
| RHOA (Ras homolog family member A; synonyms: ARHA, ARH12, RHO12, RHOH12) | Breast cancer, lung cancer, liver cancer, ovarian cancer, bladder cancer | 9656 | 173-175, 1433-1508, 2859-2872, 3330-3384, 4830-4833, 8902-8924 |
| RRAS2 (related RAS viral oncogene homolog 2) | Oral cancer, esophageal cancer, stomach cancer, skin cancer, breast cancer, lymphomas | 9658 | 1509-1514, 3495, 3714-3725, 4834-4845, 8925-8949 |
| RUNX1 (runt-related transcription factor 1; synonyms: AML1-EVI-1, CBFA2, CBF2alpha, PEBP2alpha, AML1, AMLCR1, PEBP2aB, EVI-1) | breast invasive ductal carcinoma, acute myeloid leukemia, myelodysplastic syndromes, lung adenocarcinoma, and breast invasive lobular carcinoma | 9660 | 1515-1518, 2873, 4846-4850, 8950-8966 |
| SETD2 (histone-lysine N-methyltransferase SETD2; synonyms: LLS, HIP-1, HIF-1, HYPB, p231HBP, KMT3A, HSPC069, SET2, HBP231) | lung adenocarcinoma, clear cell renal cell carcinoma, colon adenocarcinoma, breast invasive ductal carcinoma, and endometrial endometrioid adenocarcinoma | 9662 | 176-179, 1519-1532, 2874-2878, 3385-3393 |
| SF3B1 (splicing factor 3B subunit 1; synonyms: SF3b155, PRP10, Hsh155, SAP155, PRPF10, MDS) | breast invasive ductal carcinoma, lung adenocarcinoma, colon adenocarcinoma, myelodysplastic syndromes, and bladder urothelial carcinoma | 9664 | 180-204, 1533-1589, 2879-2891, 3394-3410, 3496-3498, 3726-3731, 4851-4922, 8967-9148 |

TABLE 1-continued

| Parental Gene/Protein Name | Exemplary Disease/Disorder/Cancer | Parental (SEQ ID NO) * | Drug-like peptides (SEQ ID NOs) |
|---|---|---|---|
| SKP2 (S-phase kinase associate d protein 2; synonyms: p45, FBL1, FLB1, FBXL1) | Breast cancer, lung cancer, prostate cancer, liver cancer, Ewing's Sarcoma, skin cancer | 9666 | 4923-4931, 9149-9182 |
| SMAD2 (SMAD family member 2; synonyms: JV18, MADH2, MADR2, JV18-1, hMAD-2, hSMAD2) | Colorectal cancer, breast cancer, lung cancer, pancreatic cancer, uterine sarcoma, bladder cancer, eye cancer | 9668 | 1590-1591, 2892, 3732-3733, 4932-4937, 9183-9228 |
| SMAD4 (SMAD family member 4; synonyms: JIP, DPC4, MADH4, MYHRS) | Pancreatic cancer, colorectal cancer, breast cancer, stomach cancer, lung cancer, liver cancer, adenomatous polyposis coli, cervical cancer | 9670 | 205-207, 1592-1795, 2893-2911, 3411-3426, 3734-3745, 4938-4959, 9229-9288 |
| SPOP (Speckle-type BTB/POZ; synonyms: BTBD32, TEF2, speckle type BTB/POZ protein, NEDMIDF, NSDVS1, NSDVS2, NEDMACE) | prostate, lung, colon, gastric, kidney and liver cancers | 9672 | 208, 1796-1804, 2912-2913, 3427 |
| TERT (telomerase reverse transcriptase; synonyms: PFBMFT1, TCS1, hTRT, hEST2, CMM9, DKCB4, DKCA2, EST2, TRT, TP2) | lung adenocarcinoma, colon adenocarcinoma, breast invasive ductal carcinoma, cutaneous melanoma, and conventional glioblastoma multiforme | 9674 | 4960-4976, 9289-9390 |
| TGFBR2 | colon adenocarcinoma, lung adenocarcinoma, pancreatic adenocarcinoma, cutaneous melanoma, and breast invasive ductal carcinoma | 9676 | 1805, 3746-3749, 4977-4988, 9391-9417 |
| TP53 (cellular tumor antigen p53; synonyms: BCC7, TRP53, P53, LFS1) | lung adenocarcinoma, breast invasive ductal carcinoma, colon adenocarcinoma, pancreatic adenocarcinoma, and colorectal adenocarcinoma | 9678 | 209-341, 1806-2482, 2914-2943, 3428-3439, 4989-4990, 9418-9432 |
| VHL (von Hippel-Lindau disease tumor suppressor; synonyms: RCA1, VHL1, HRCA1, pVHL) | clear cell renal cell carcinoma, renal cell carcinoma, lung adenocarcinoma, breast invasive ductal carcinoma, and bladder urothelial carcinoma | 9680 | 342-349, 2483-2553, 2944-2948, 3440-3442, 4991-4997, 9433-9440 |
| YAP1 (transcription coactivator YAP1; synonyms: YAP, YAP2, YAP65, COB1, YKI) | breast invasive ductal carcinoma, lung adenocarcinoma, bladder urothelial carcinoma, cutaneous melanoma, and head and neck squamous cell carcinoma | 9682 | 4998-4999, 9441-9459 |
| ZFP36L2 (zinc finger protein 36 ring finger protein-like 2) | Colorectal cancer, ovarian cancer, endometrial cancer, skin cancer, testicular cancer, urothelial cancer, pancreatic cancer and liver cancer | 9684 | 2554 |
| ACE2 (angiotensin-converting enzyme 2) | serves as the entry point for some coronaviruses, including HCoV-NL63, SARS-CoV, and SARS-CoV-2 | 9686 | 9460-9470 |
| ACE1 (angiotensin-converting enzyme 1) | serves as the entry point for some coronaviruses, including HCoV-NL63, SARS-CoV, and SARS-CoV-2 | 9688 | 9471-9472, 9489 |
| DPP9 (dipeptidyl peptidase 9) | serves as the entry point for some coronaviruses | 9690 | 9473-9474, 9488 |
| ANPEP (alanine aminopeptidase N) | serves as the entry point for some coronaviruses | 9692 | 9475-9476, 9486 |
| FAP (prolyl endopeptidase FAP) | serves as the entry point for some coronaviruses | 9694 | 9477-9478, 9485 |
| DPP4 (dipeptidyl peptidase 4) | serves as the entry point for some coronaviruses | 9696 | 9479-9480, 9483 |
| Fibronectin | serves as the entry point for some coronaviruses | 9698 | 9481-9482, 9484 |
| DPP8 (dipeptidyl peptidase 8) | serves as the entry point for some coronaviruses | 9700 | 9487 |

* Mutants are also contemplated. As used herein, e.g., "289T" refers to a mutation at position 289, wherein position 289 can be T. Similarly, "782R/V" refers to a mutation at position 782, wherein position 782 can be R or V.

The disclosure provides, in one embodiment, a comprehensive screening platform which enables the identification of peptide inhibitors of pathological processes. This methodology can be scalable due to the ease of oligonucleotide synthesis, simple to perform, and highly precise, allowing users to interrogate proteins with single amino acid resolution. Because the library of peptide coding gene fragments can be user defined and custom synthesized, this strategy can be easily adaptable to diverse studies where a selection strategy can be devised to enrich or deplete cells with the phenotype of interest. Inhibitory peptides have immense potential as both research tools and therapeutics. Direct inhibition of protein activity without genetic alteration opens unique screening avenues with which to probe protein function. For example, protein-protein interaction networks could be more precisely perturbed via inhibitory peptides contacting a specific protein surface than by complete genetic knockdown. The ability to identify protein regions associated with cell fitness can also serve to complement traditional drug development efforts, such as determining critical residues for inhibition via small molecules or antibodies. Additionally, this screening resource identifies inhibitory peptides that are immediately translatable, bypassing the need for additional high-throughput screens to identify candidate molecules. Functionally, peptides can be: 1) readily made cell permeable via coupling of cell penetrating motifs to enable drug-like function; or alternatively, 2) coupled to chemical moieties such as poly-ethylene glycol (PEG) or protein domains with naturally long serum half-life such as Fc, transferrin or albumin to improve persistence in circulation. For example, using the methods of the disclosure drug-like peptides were generated that opposed triple-negative breast cancer cell growth in vitro as effectively as some FDA approved small molecules targeting the same proteins. Advances in biologics delivery will further improve the translational relevance of this strategy. We anticipate a future role for this method of peptide inhibitor screening in both basic research and drug development.

The peptides of the disclosure (see, e.g., SEQ ID NOs: 1-9489) can be delivered to cells or subjects in a number of different ways known to those of skill in the art. For example, the peptides themselves may be formulated for delivery directly or they maybe engineered to comprise delivery molecules to assist in their targeting or uptake. For example, suitable delivery molecules include protein transduction domains (PTDs) (sometimes referred to as cell penetrating peptides (CPPs)), nanoparticles, liposomes etc.

In other embodiments, the polynucleotide encoding the peptides of the disclosure can be delivered to a cell such that they are "expressed" in the cell and provide their biological effect via the expression of the polynucleotide. Typically such polynucleotides will be operably linked to an expression control sequence (e.g., promoter, enhancer etc.). Depending upon the cell expressing the polynucleotide suitable promoters and/or vectors can be selected such that delivery and expression occur. In some embodiments, the vector used to deliver a polynucleotide encoding a peptide of the disclosure is a viral vector. Such viral vectors can be replication competent or replication defective. The viral vectors whether replication competent or replication defective can be "derived" (e.g., engineered from) any number of viral vector systems known in the art. For example, suitable viral vectors that can be engineered to contain a polynucleotide of the disclosure comprise gammaretroviruses (e.g., MLV), lentivirus, adenoviruses, alphaviruses etc. In some cases, where the viral vector is replication defective a suitable helper cell system is used.

Replication competent retroviral systems will typically comprise a viral capsid comprising GAG, POL and ENV proteins and a viral genome comprising sequences encoding GAG, POL and ENV as well as factors necessary for the integration and packaging of the viral genome. A cassette is typically engineered into the viral genome, wherein the cassette comprises an IRES, promoter or other regulatory factor upstream of the coding sequence of a peptide of the disclosure. The cassette is typically integrated into the viral genome in a location that does not disrupt expression of necessary viral genes and is typically located downstream of the env coding sequence or in the LTRs of the viral genome.

As described herein, the disclosure provides peptides that have dominant negative activity and have, for example, anticancer effects. In one embodiment, the peptides inhibit the biological activity of the molecule from which they are derived. By "anticancer effect" means that the molecule inhibits, for example, aberrant proliferative activity, invasiveness, cell growth, migration and any combinations thereof. The disclosure contemplates that the peptides of the disclosure can be delivered in a number of ways.

Cellular delivery can be accomplished by fusion of "cargo" biological agents (in this case the peptides of the disclosure) to a cationic Peptide Transduction Domain (PTD; also termed Cell Penetrating Peptide (CPP)) such as TAT or ($Arg_8$) (Snyder and Dowdy, 2005, *Expert Opin. Drug Deliv.* 2, 43-51). PTDs can be used to deliver a wide variety of macromolecular cargo, including the peptides described herein. Cationic PTDs enter cells by macropinocytosis, a specialized form of fluid phase uptake that all cells perform.

The discovery of several proteins which could efficiently pass through the plasma membrane of eukaryotic cells has led to the identification of a class of proteins from which peptide transduction domains have been derived. The best characterized of these proteins are the Drosophila homeoprotein antennapedia transcription protein (AntHD) (Joliot et al., *New Biol.* 3:1121-34, 1991; Joliot et al., *Proc. Natl. Acad. Sci. USA,* 88:1864-8, 1991; Le Roux et al., *Proc. Natl. Acad. Sci. USA,* 90:9120-4, 1993), the herpes simplex virus structural protein VP22 (Elliott and O'Hare, *Cell* 88:223-33, 1997), the HIV-1 transcriptional activator TAT protein (Green and Loewenstein, *Cell* 55:1179-1188, 1988; Frankel and Pabo, *Cell* 55:1189-1193, 1988), and more recently the cationic N-terminal domain of prion proteins. Exemplary PTD sequences are provided in Table 2. The disclosure further provides for one or more of the PTDs listed in Table 2 or other PTDs known in the art (see, e.g., Joliot et al., *Nature Cell Biology,* 6(3):189-196, 2004) to be conjugated to the peptides disclosed herein. Strategies for conjugation include the use of a bifunctional linker that includes a functional group that can be cleaved by the action of an intracellular enzyme.

TABLE 2

| PTD | Sequence | SEQ ID NO. |
|---|---|---|
| TAT | RKKRRQRRR | SEQ ID NO: 9490 |
| Penetratin | RQIKIWFQNRRMK WKK | SEQ ID NO: 9491 |
| Buforin II | TRSSRAGLQFPVG RVHRLLRK | SEQ ID NO: 9492 |
| Transportan | GWTLNSAGYLLGKI NKALAALAKKIL | SEQ ID NO: 9493 |
| MAP (model amphipathic peptide) | KLALKLALKALKA ALKLA | SEQ ID NO: 9494 |
| K-FGF | AAVALLPAVLLAL LAP | SEQ ID NO: 9495 |
| Ku70 | VPMLK - PMLKE | SEQ ID NO: 9496 |
| Prion | MANLGYWLLALFVT MWTDVGLCKKRPKP | SEQ ID NO: 9497 |
| pVEC | LLIILRRRIRKQAH AHSK | SEQ ID NO: 9498 |
| Pep-1 | KETWWETWWTEWS QPKKKRKV | SEQ ID NO: 9499 |

TABLE 2-continued

| PTD | Sequence | SEQ ID NO. |
|---|---|---|
| SynB1 | RGGRLSYSRRRFST STGR | SEQ ID NO: 9500 |
| Pep-7 (phage display) | SDLWEMMMVSLACQY | SEQ ID NO: 9501 |
| HN-1 (phage display) | TSPLNIHNGQKL | SEQ ID NO: 9502 |

Exemplary auxiliary moieties that can be conjugated to any of the constructs described herein are provided in Table 3.

TABLE 3

| Sequence (N' to C') (PTD = protein transduction domain) |
|---|
| PEG-(PTD) |
| GG-(PTD)-PEG-(PTD) |
| PEG-(PTD)-PEG-(PTD) |
| GG-(PTD)-PEG-PEG-PEG-(PTD) |
| PEG-(PTD)-PEG-PEG-PEG-(PTD) |
| GG-(PTD)-PEG-(PTD)-PEG-(PTD) |
| GG-(PTD)-PEG-PEG-PEG-(PTD)-PEG-PEG-PEG-(PTD) |

PEG = poly(ethyleneglycol) linker having two-six repeat units

In one embodiment, a PTD useful in the methods and compositions of the disclosure comprises a peptide or polypeptide featuring substantial alpha-helicity. It has been discovered that transfection can be optimized when the PTD exhibits significant alpha-helicity. In another embodiment, the PTD comprises a sequence containing basic amino acid residues that are substantially aligned along at least one face of the peptide or polypeptide. A PTD domain useful in the disclosure may be a naturally occurring peptide or polypeptide or a synthetic peptide or polypeptide.

In another embodiment, the PTD comprises an amino acid sequence comprising a strong alpha helical structure with arginine (Arg) residues down the helical cylinder.

In yet another embodiment, the PTD domain comprises a peptide represented by the following general formula: $B_{P1}$-$X_{P1}$-$X_{P2}$-$X_{P3}$-$B_{P2}$-$X_{P4}$-$X_{P5}$-$B_{P3}$ (SEQ ID NO:9503) wherein $B_{P1}$, $B_{P2}$, and $B_{P3}$ are each independently a basic amino acid, the same or different; and $X_{P1}$, $X_{P2}$, $X_{P3}$, $X_{P4}$, and $X_{P5}$ are each independently an alpha-helix enhancing amino acid, the same or different.

In another embodiment, the PTD domain is represented by the following general formula: $B_{P1}$-$X_{P1}$-$X_{P2}$-$B_{P2}$-$B_{P3}$-$X_{P3}$-$X_{P4}$-$B_{P4}$ (SEQ ID NO:9504) wherein $B_{P1}$, $B_{P2}$, $B_{P2}$, and $B_{P4}$ are each independently a basic amino acid, the same or different; and $X_{P1}$, $X_{P2}$, $X_{P3}$, and $X_{P4}$ are each independently an alpha-helix enhancing amino acid the same or different.

Additionally, PTD domains comprise basic residues, e.g., lysine (Lys) or arginine (Arg), and further can include at least one proline (Pro) residue sufficient to introduce "kinks" into the domain. Examples of such domains include the transduction domains of prions. For example, such a peptide comprises KKRPKPG (SEQ ID NO:9505).

In another embodiment the PTD is cationic and consists of between 7 and 10 amino acids. An example of such a peptide comprises RKKRRQRRR (SEQ ID NO:9490). In another example, the PTD is a cationic peptide sequence having 5-10 arginine (and/or lysine) residues over 5-15 amino acids.

Additional delivery domains in accord with this disclosure include a TAT fragment that comprises at least amino acids 49 to 56 of TAT up to about the full-length TAT sequence (see, e.g., SEQ ID NO:9490). A TAT fragment may include one or more amino acid changes sufficient to increase the alpha-helicity of the fragment. In some instances, the amino acid changes introduced will involve adding a recognized alpha-helix enhancing amino acid. Alternatively, the amino acid changes will involve removing one or more amino acids from the TAT fragment that impede alpha helix formation or stability. In a more specific embodiment, the TAT fragment will include at least one amino acid substitution with an alpha-helix enhancing amino acid. Typically the TAT fragment will be made by standard peptide synthesis techniques although recombinant DNA approaches may be used in some cases. In one embodiment, the substitution is selected so that at least two basic amino acid residues in the TAT fragment are substantially aligned along at least one face of that TAT fragment. In a more specific embodiment, the substitution is chosen so that at least two basic amino acid residues in the TAT 49-56 sequence are substantially aligned along at least one face of that sequence.

Additional transduction proteins (PTDs) that can be used in the compositions and methods of the disclosure include the TAT fragment in which the TAT 49-56 sequence has been modified so that at least two basic amino acids in the sequence are substantially aligned along at least one face of the TAT fragment. Illustrative TAT fragments include at least one specified amino acid substitution in at least amino acids 49-56 of TAT which substitution aligns the basic amino acid residues of the 49-56 sequence along at least one face of the segment and typically the TAT 49-56 sequence.

Thus, PTDs that can be conjugated to a peptide of the disclosure include, but are not limited to, AntHD, TAT, VP22, cationic prion protein domains, and functional fragments thereof. Not only can these peptides pass through the plasma membrane, but the attachment of other peptide or polypeptides are sufficient to stimulate the cellular uptake of these complexes. Such chimeric peptides/polypeptide are present in a biologically active form within the cytoplasm and nucleus. Characterization of this process has shown that the uptake of these fusion polypeptides can be rapid, often occurring within minutes, in a receptor independent fashion. Moreover, the transduction of these proteins does not appear to be affected by cell type, and these proteins can efficiently transduce ~100% of cells in culture with no apparent toxicity (Nagahara et al., *Nat. Med.* 4:1449-52, 1998).

In a particular embodiment, the disclosure therefore provides methods and compositions that combine the use of PTDs, such as TAT and poly-Arg, with a drug-like peptide disclosed herein to facilitate the uptake of the construct into and/or release within targeted cells. The drug-like peptides disclosed herein can be delivered into cells using one or more PTDs linked to the drug-like peptide.

In general, the delivery domain that is linked to a drug-like peptide disclosed herein can be nearly any synthetic or naturally-occurring amino acid sequence which assists in the intracellular delivery of a construct disclosed herein into targeted cells. For example, delivery of a drug-like peptide (see, Table 1) in accordance with the disclosure can be accomplished by use of a peptide transduction domain, such as an HIV TAT protein or fragment thereof, that is covalently linked to a drug-like peptide of the disclosure. Alternatively, the peptide transduction domain can comprise the Antennapedia homeodomain or the HSV VP22 sequence, the N-terminal fragment of a prion protein or suitable transducing fragments thereof such as those known in the art.

The type and size of the PTD will be guided by several parameters including the extent of transfection desired. Typically the PTD will be capable of transfecting at least about 20%, 25%, 50%, 75%, 80% or 90%, 95%, 98% and up to, and including, about 100% of the cells. Transfection efficiency, typically expressed as the percentage of transfected cells, can be determined by several conventional methods.

PTDs will manifest cell entry and exit rates (sometimes referred to as $k_1$ and $k_2$, respectively) that favor at least picomolar amounts of a construct disclosed herein into a targeted cell. The entry and exit rates of the PTD and any cargo can be readily determined or at least approximated by standard kinetic analysis using detectably-labeled fusion molecules. Typically, the ratio of the entry rate to the exit rate will be in the range of between about 5 to about 100 up to about 1000.

Also included are chimeric PTD domains. Such chimeric PTDs include parts of at least two different transducing proteins. For example, chimeric PTDs can be formed by fusing two different TAT fragments, e.g., one from HIV-1 and the other from HIV-2 or one from a prion protein and one from HIV.

Peptide linkers that can be used in the constructs and methods of the disclosure will typically comprise up to about 20 or 30 amino acids, commonly up to about 10 or 15 amino acids, and still more often from about 1 to 5 amino acids. The linker sequence is generally flexible so as not to hold the fusion molecule in a single rigid conformation. The linker sequence can be used, e.g., to space the PTD domain from a drug-like peptide to be delivered. For example, the peptide linker sequence can be positioned between the peptide transduction domain and the therapeutic drug-like peptide domain, e.g., to provide molecular flexibility. The length of the linker moiety can be chosen to optimize the biological activity of the peptide or polypeptide comprising, for example, a PTD domain fusion construct and can be determined empirically without undue experimentation. Examples of linker moieties are -Gly-Gly-, GGGGS (SEQ ID NO:9506), wherein SEQ ID NO:19 can be repeated 1 or more times, GKSSGSGSESKS (SEQ ID NO:9507), GSTSGSGKSSEGKG (SEQ ID NO:9508), GSTSGSGKSSEGSGSTKG (SEQ ID NO:9509), GSTSGSGKPGSGEGSTKG (SEQ ID NO:9510), or EGKSSGSGSESKEF (SEQ ID NO:9511). Peptide or polypeptide linking moieties are described, for example, in Huston et al., *Proc. Nat'l Acad. Sci.* 85:5879, 1988; Whitlow et al., Protein Engineering 6:989, 1993; and Newton et al., *Biochemistry* 35:545, 1996. Other suitable peptide or polypeptide linkers are those described in U.S. Pat. Nos. 4,751,180 and 4,935,233, which are hereby incorporated by reference.

The amino acid sequences of the various oncogenic and receptor proteins described herein are provided and known in the art (see, Table 1). The drug-like peptides of the disclosure (see, Table 1), may be synthesized by solid-phase peptide synthesis methods using procedures similar to those described by Merrifield et al., J. Am. Chem. Soc., 85:2149-2156 (1963); Barany and Merrifield, Solid-Phase Peptide Synthesis, in The Peptides: Analysis, Synthesis, Biology Gross and Meienhofer (eds.), Academic Press, N.Y., vol. 2, pp. 3-284 (1980); and Stewart et al., Solid Phase Peptide Synthesis 2nd ed., Pierce Chem. Co., Rockford, Ill. (1984). During synthesis, N-α-protected amino acids having protected side chains are added stepwise to a growing polypeptide chain linked by its C-terminal and to a solid support, e.g., polystyrene beads. The peptides are synthesized by linking an amino group of an N-α-deprotected amino acid to an α-carboxy group of an N-α-protected amino acid that has been activated by reacting it with a reagent such as dicyclohexylcarbodiimide. The attachment of a free amino group to the activated carboxyl leads to peptide bond formation. A commonly used N-α-protecting groups include Boc, which is acid labile, and Fmoc, which is base labile.

Materials suitable for use as the solid support are well known to those of skill in the art and include, but are not limited to: halomethyl resins, such as chloromethyl resin or bromomethyl resin; hydroxymethyl resins; phenol resins, such as 4-(α[2,4-dimethoxyphenyl]-Fmoc-aminomethyl) phenoxy resin; tert-alkyloxycarbonyl-hydrazidated resins, and the like. Such resins are commercially available and their methods of preparation are known by those of ordinary skill in the art.

Briefly, the C-terminal N-α-protected amino acid can be first attached to the solid support. The N-α-protecting group can then be removed. The deprotected α-amino group can be coupled to the activated a-carboxylate group of the next N-α-protected amino acid. The process can be repeated until the desired peptide is synthesized. The resulting peptides are then cleaved from the insoluble polymer support and the amino acid side chains deprotected. Longer peptides can be derived by condensation of protected peptide fragments. Details of appropriate chemistries, resins, protecting groups, protected amino acids and reagents are well known in the art and so are not discussed in detail herein (See, Atherton et al., Solid Phase Peptide Synthesis: A Practical Approach, IRL Press (1989), and Bodanszky, Peptide Chemistry, A Practical Textbook, 2nd Ed., Springer-Verlag (1993)).

Following verification of the coding sequence, a peptide of interest (e.g., a drug-like peptide of the disclosure) can be produced using routine techniques in the field of recombinant molecular biology, relying on the polynucleotide sequences encoding the peptide. The coding sequence of the peptide can be easily deduced using the degeneracy of the genetic code and a codon table.

To obtain high level expression of a nucleic acid encoding a peptide of interest, one typically subclones the polynucleotide coding sequence into an expression vector that contains a strong promoter to direct transcription, a transcription/translation terminator and a ribosome binding site for translational initiation. Suitable bacterial promoters are well known in the art and described, e.g., in Sambrook and Russell, supra, and Ausubel et al. Bacterial expression systems for expressing recombinant polypeptides are available in, e.g., *E. coli, Bacillus* sp., *Salmonella*, and *Caulobacter*. Kits for such expression systems are commercially available. Eukaryotic expression systems for mammalian cells, yeast, and insect cells are well known in the art and are also commercially available. In one embodiment, the eukaryotic expression vector is an adenoviral vector, an adeno-associated vector, or a retroviral vector.

The promoter used to direct expression of a heterologous nucleic acid depends on the particular application. In some embodiments, the promoter is optionally positioned about the same distance from the heterologous transcription start site as it is from the transcription start site in its natural setting. As is known in the art, however, some variation in this distance can be accommodated without loss of promoter function.

In addition to the promoter, the expression vector typically includes a transcription unit or expression cassette that contains all the additional elements required for the expression of the desired peptide in host cells. A typical expression cassette thus contains a promoter operably linked to the nucleic acid sequence encoding the peptide and signals required for efficient polyadenylation of the transcript, ribosome binding sites, and translation termination. The nucleic acid sequence encoding the desired peptide is typically linked to a cleavable signal peptide sequence to promote secretion of the recombinant polypeptide by the transformed cell. Such signal peptides include, among others, the signal peptides from tissue plasminogen activator, insulin, and neuron growth factor, and juvenile hormone esterase of Heliothis virescens. If, however, a recombinant polypeptide is intended to be expressed on the host cell surface, an appropriate anchoring sequence is used in concert with the coding sequence. Additional elements of the cassette may include enhancers and, if genomic DNA is used as the structural gene, introns with functional splice donor and acceptor sites.

In addition to a promoter sequence, the expression cassette should also contain a transcription termination region downstream of the structural peptide coding sequence to provide for efficient termination. The termination region may be obtained from the same gene as the promoter sequence or may be obtained from different genes.

The particular expression vector used to transport the genetic information into the cell is not particularly critical. Any of the conventional vectors used for expression in eukaryotic or prokaryotic cells may be used. Standard bacterial expression vectors include plasmids such as pBR322 based plasmids, pSKF, pET23D, and fusion expression systems such as GST and LacZ. Epitope tags can also be added to recombinant proteins to provide convenient methods of isolation, e.g., c-myc.

Expression vectors containing regulatory elements from eukaryotic viruses are typically used in eukaryotic expression vectors, e.g., SV40 vectors, papilloma virus vectors, and vectors derived from Epstein-Barr virus. Other exemplary eukaryotic vectors include pMSG, pAV009/$A^+$, pMTO10/$A^+$, pMAMneo-5, baculovirus pDSVE, and any other vector allowing expression of proteins under the direction of the SV40 early promoter, SV40 later promoter, metallothionein promoter, murine mammary tumor virus promoter, Rous sarcoma virus promoter, polyhedrin promoter, or other promoters shown effective for expression in eukaryotic cells.

Some expression systems have markers that provide gene amplification such as thymidine kinase, hygromycin B phosphotransferase, and dihydrofolate reductase. Alternatively, high yield expression systems not involving gene amplification are also suitable, such as a baculovirus vector in insect cells, with a polynucleotide sequence encoding the desired peptide under the direction of the polyhedrin promoter or other strong baculovirus promoters.

When periplasmic expression of a recombinant polypeptide is desired, the expression vector further comprises a sequence encoding a secretion signal, such as the *E. coli* OppA (Periplasmic Oligopeptide Binding Protein) secretion signal or a modified version thereof, which is directly connected to 5' of the coding sequence of the peptide to be expressed. This signal sequence directs the recombinant peptide produced in the cytoplasm through the cell membrane into the periplasmic space. The expression vector may further comprise a coding sequence for signal peptidase 1, which is capable of enzymatically cleaving the signal sequence when the recombinant peptide is entering the periplasmic space. More detailed description for periplasmic production of a recombinant protein can be found in, e.g., Gray et al., Gene 39: 247-254 (1985), U.S. Pat. Nos. 6,160,089 and 6,436,674.

Standard transfection methods are used to produce bacterial, mammalian, yeast, insect, or plant cell lines that express large quantities of a recombinant peptide or polypeptide, which are then purified using standard techniques (see, e.g., Colley et al., J. Biol. Chem. 264: 17619-17622 (1989); Guide to Protein Purification, in Methods in Enzymology, vol. 182 (Deutscher, ed., 1990)). Transformation of eukaryotic and prokaryotic cells are performed according to standard techniques (see, e.g., Morrison, J. Bact. 132: 349-351 (1977); Clark-Curtiss & Curtiss, Methods in Enzymology 101: 347-362 (Wu et al., eds, 1983).

Any of the well-known procedures for introducing foreign nucleotide sequences into host cells may be used. These include the use of calcium phosphate transfection, polybrene, protoplast fusion, electroporation, liposomes, microinjection, plasma vectors, viral vectors and any of the other well-known methods for introducing cloned genomic DNA, cDNA, synthetic DNA, or other foreign genetic material into a host cell. In some embodiments, it is only necessary that the particular genetic engineering procedure used be capable of successfully introducing at least one gene into the host cell capable of expressing the recombinant polypeptide.

In some embodiments, once the expression of a recombinant peptide in transfected host cells is confirmed, e.g., by an immunological assay, activity assay or sequencing, the host cells are then cultured in an appropriate scale for the purpose of purifying the recombinant peptide.

When desired polypeptides are produced recombinantly by transformed bacteria in large amounts, typically after promoter induction, although expression can be constitutive, the polypeptides may form insoluble aggregates. There are several protocols that are suitable for purification of protein inclusion bodies. For example, purification of aggregate proteins (hereinafter referred to as inclusion bodies) typically involves the extraction, separation and/or purification of inclusion bodies by disruption of bacterial cells, e.g., by incubation in a buffer of about 100-150 μg/ml lysozyme and 0.1% Nonidet P40, a non-ionic detergent. The cell suspension can be ground using a Polytron grinder (Brinkman Instruments, Westbury, N.Y.). Alternatively, the cells can be sonicated on ice. Alternate methods of lysing bacteria are described in Ausubel et al. and Sambrook and Russell, and will be apparent to those of skill in the art.

The cell suspension is generally centrifuged and the pellet containing the inclusion bodies resuspended in buffer which does not dissolve but washes the inclusion bodies, e.g., 20 mM Tris-HCl (pH 7.2), 1 mM EDTA, 150 mM NaCl and 2% Triton-X 100, a non-ionic detergent. It may be necessary to repeat the wash step to remove as much cellular debris as possible. The remaining pellet of inclusion bodies may be resuspended in an appropriate buffer (e.g., 20 mM sodium phosphate, pH 6.8, 150 mM NaCl). Other appropriate buffers will be apparent to those of skill in the art.

Following the washing step, the inclusion bodies are solubilized by the addition of a solvent that can be both a strong hydrogen acceptor and a strong hydrogen donor (or a combination of solvents each having one of these properties). The peptides that formed the inclusion bodies may then be renatured by dilution or dialysis with a compatible buffer.

Suitable solvents include, but are not limited to, urea (from about 4 M to about 8 M), formamide (at least about 80%, volume/volume basis), and guanidine hydrochloride (from about 4 M to about 8 M). Some solvents that are capable of solubilizing aggregate-forming peptides, such as SDS (sodium dodecyl sulfate) and 70% formic acid, may be inappropriate for use in this procedure due to the possibility of irreversible denaturation of the peptides, accompanied by a lack of immunogenicity and/or activity. Although guanidine hydrochloride and similar agents are denaturants, this denaturation may not be irreversible and renaturation may occur upon removal (by dialysis, for example) or dilution of the denaturant, allowing re-formation of the immunologically and/or biologically active protein of interest. After solubilization, the peptide can be separated from other bacterial proteins by standard separation techniques. For further description of purifying recombinant peptides from bacterial inclusion body, see, e.g., Patra et al., Protein Expression and Purification 18: 182-190 (2000).

Alternatively, it is possible to purify recombinant peptides from bacterial periplasm. In some cases, where the recombinant peptide is exported into the periplasm of the bacteria, the periplasmic fraction of the bacteria can be isolated by cold osmotic shock in addition to other methods known to those of skill in the art (see e.g., Ausubel et al., supra). To isolate recombinant peptides from the periplasm, the bacterial cells can be centrifuged to form a pellet. The pellet is resuspended in a buffer containing 20% sucrose. To lyse the cells, the bacteria can be centrifuged and the pellet can then be resuspended in ice-cold 5 mM $MgSO_4$ and kept in an ice bath for approximately 10 minutes. The cell suspension can be centrifuged and the supernatant decanted and saved. The recombinant peptides present in the supernatant can be separated from the host proteins by standard separation techniques well known to those of skill in the art.

When a recombinant polypeptide or peptide is expressed in host cells in a soluble form, its purification can follow the standard protein purification procedure described below. This standard purification procedure can also be suitable for purifying polypeptides obtained from chemical synthesis.

In some embodiments, as an initial step, and if the protein mixture is complex, an initial salt fractionation can separate many of the unwanted host cell proteins (or proteins derived from the cell culture media) from the recombinant peptide of interest. A typical salt is ammonium sulfate. Ammonium sulfate precipitates polypeptides by effectively reducing the amount of water in the protein mixture. Proteins then precipitate on the basis of their solubility. The more hydrophobic a protein is, the more likely it is to precipitate at lower ammonium sulfate concentrations. A typical protocol is to add saturated ammonium sulfate to a protein solution so that the resultant ammonium sulfate concentration is between 20-30%. In some cases, this will precipitate the most hydrophobic proteins. The precipitate can be discarded (unless the protein of interest is hydrophobic) and ammonium sulfate can be added to the supernatant to a concentration known to precipitate the protein of interest. The precipitate can then be solubilized in buffer and the excess salt removed if necessary, through either dialysis or diafiltration. Other methods that rely on solubility of proteins, such as cold ethanol precipitation, are well known to those of skill in the art and can be used to fractionate complex protein mixtures.

The drug-like peptides of the disclosure can also be separated from other proteins on the basis of their size, net surface charge, hydrophobicity, or affinity for ligands.

For delivery to a cell or organism, a nucleic acid encoding a drug-like peptide of the disclosure can be incorporated into a vector. Examples of vectors used for such purposes include expression plasmids capable of directing the expression of the drug-like peptide in the target cell. In other instances, the vector can be a viral vector system wherein the nucleic acid encoding the drug-like peptide is incorporated into a viral genome that is capable of transfecting the target cell.

As used herein, "gene delivery system" refers to any means for the delivery of a nucleic acid encoding a drug-like peptide of the disclosure to a target cell. Viral vector systems useful in the introduction and expression of a nucleic acid include, for example, naturally occurring or recombinant viral vector systems. Depending upon the particular application, suitable viral vectors include replication competent, replication deficient, and conditionally replicating viral vectors. For example, viral vectors can be derived from the genome of human or bovine adenoviruses, vaccinia virus, herpes virus, adeno-associated virus, minute virus of mice (MVM), HIV, sindbis virus, and retroviruses (including but not limited to Rous sarcoma virus), and MoMLV. Typically, the nucleic acid is inserted into such vectors to allow packaging of the gene construct, typically with accompanying viral DNA, followed by infection of a sensitive host cell and expression of the gene of interest.

Similarly, viral envelopes used for packaging gene constructs that include the nucleic acid can be modified by the addition of receptor ligands or antibodies specific for a receptor to permit receptor-mediated endocytosis into specific cells.

Retroviral vectors may also be useful for introducing the nucleic acid into target cells or organisms. Retroviral vectors are produced by genetically manipulating retroviruses. The viral genome of retroviruses is RNA. Upon infection, this genomic RNA is reverse transcribed into a DNA copy that is integrated into the chromosomal DNA of transduced cells with a high degree of stability and efficiency. The integrated DNA copy is referred to as a provirus and is inherited by daughter cells as is any other gene. The wild type retroviral genome and the proviral DNA comprise three genes: the gag, the pol and the env genes, which are flanked by two long terminal repeat (LTR) sequences. The gag gene encodes the internal structural (nucleocapsid) proteins; the pol gene encodes the RNA directed DNA polymerase (reverse transcriptase); and the env gene encodes viral envelope glycoproteins. The 5' and 3' LTRs serve to promote transcription and polyadenylation of virion RNAs. Adjacent to the 5' LTR are sequences necessary for reverse transcription of the genome (the tRNA primer binding site) and for efficient encapsulation of viral RNA into particles (the Psi site) (see, Mulligan, In: Experimental Manipulation of Gene Expression, Inouye (ed), 155-173 (1983); Mann et al., Cell 33:153-159 (1983); Cone and Mulligan, Proceedings of the National Academy of Sciences, U.S.A., 81:6349-6353 (1984)).

The design of retroviral vectors is well known to those of ordinary skill in the art. In brief, if the sequences necessary for encapsidation (or packaging of retroviral RNA into infectious virions) are missing from the viral genome, the result is a cis acting defect which prevents encapsidation of genomic RNA. However, the resulting mutant is still capable of directing the synthesis of all virion proteins. Retroviral genomes from which these sequences have been deleted, as well as cell lines containing the mutant genome stably integrated into the chromosome are well known in the art and are used to construct retroviral vectors. Preparation of retroviral vectors and their uses are described in many publications including, e.g., European Patent Application EPA 0 178 220; U.S. Pat. No. 4,405,712, Gilboa Biotechniques 4:504-512 (1986); Mann et al., Cell 33:153-159 (1983); Cone and Mulligan Proc. Natl. Acad. Sci. USA 81:6349-6353 (1984); Eglitis et al. Biotechniques 6:608-614 (1988); Miller et al. Biotechniques 7:981-990 (1989); Miller (1992) supra; Mulligan (1993), supra; and WO 92/07943.

The retroviral vector particles are prepared by recombinantly inserting the desired nucleic acid sequence encoding a drug-like peptide of the disclosure into a retrovirus vector and packaging the vector with retroviral capsid proteins by use of a packaging cell line. The resultant retroviral vector particle is incapable of replication in the host cell but is capable of integrating into the host cell genome as a proviral sequence containing the desired nucleotide sequence.

Delivery of a drug-like peptide of the disclosure can be achieved by contacting a cell with a nucleic acid construct or using direct delivery of the drug-like peptide or fusion peptide. In a particular embodiment, a drug-like peptide of the disclosure (e.g., a therapeutic peptide) can be formulated with various carriers, dispersion agents and the like, as are described more fully elsewhere herein.

A pharmaceutical composition according to the disclosure can be prepared to include a drug-like peptide as disclosed herein, into a form suitable for administration to a subject using carriers, excipients, and additives or auxiliaries. Frequently used carriers or auxiliaries include magnesium carbonate, titanium dioxide, lactose, mannitol and other sugars, talc, milk protein, gelatin, starch, vitamins, cellulose and its derivatives, animal and vegetable oils, polyethylene glycols and solvents, such as sterile water, alcohols, glycerol, and polyhydric alcohols. Intravenous vehicles include fluid and nutrient replenishers. Preservatives include antimicrobial, anti-oxidants, chelating agents, and inert gases. Other pharmaceutically acceptable carriers include aqueous solutions, non-toxic excipients, including salts, preservatives, buffers and the like, as described, for instance, in Remington's Pharmaceutical Sciences, and The National Formulary, 30th ed., the contents of which are hereby incorporated by reference. The pH and exact concentration of the various components of the pharmaceutical composition are adjusted according to routine skills in the art. See Goodman and Gilman's, The Pharmacological Basis for Therapeutics.

The pharmaceutical compositions according to the disclosure may be administered locally or systemically. The therapeutically effective amounts will vary according to factors, such as the degree of infection in a subject, the age, sex, and weight of the individual. Dosage regimes can be adjusted to provide the optimum therapeutic response. For example, several divided doses can be administered daily or the dose can be proportionally reduced as indicated by the exigencies of the therapeutic situation.

The pharmaceutical composition can be administered in a convenient manner, such as by injection (e.g., subcutaneous, intravenous, intraorbital, and the like), oral administration, ophthalmic application, inhalation, transdermal application, topical application, or rectal administration. Depending on the route of administration, the pharmaceutical composition can be coated with a material to protect the pharmaceutical composition from the action of enzymes, acids, and other natural conditions that may inactivate the pharmaceutical composition. The pharmaceutical composition can also be administered parenterally or intraperitoneally. Dispersions can also be prepared in glycerol, liquid polyethylene glycols, and mixtures thereof, and in oils. Under ordinary conditions of storage and use, these preparations may contain a preservative to prevent the growth of microorganisms.

Pharmaceutical compositions suitable for injectable use include sterile aqueous solutions (where water soluble) or dispersions and sterile powders for the extemporaneous preparation of sterile injectable solutions or dispersions. The composition will typically be sterile and fluid to the extent that easy syringability exists. Typically, the composition will be stable under the conditions of manufacture and storage and preserved against the contaminating action of microorganisms, such as bacteria and fungi. The carrier can be a solvent or dispersion medium containing, for example, water, ethanol, polyol (for example, glycerol, propylene glycol, and liquid polyethylene glycol, and the like), suitable mixtures thereof, and vegetable oils. The proper fluidity can be maintained, for example, by the use of a coating, such as lecithin, by the maintenance of the required particle size, in the case of dispersion, and by the use of surfactants. Prevention of the action of microorganisms can be achieved by various antibacterial and antifungal agents, for example, parabens, chlorobutanol, phenol, ascorbic acid, thimerosal, and the like. In many cases, isotonic agents, for example, sugars, polyalcohols, such as mannitol, sorbitol, or sodium chloride are used in the composition. Prolonged absorption of the injectable compositions can be brought about by including in the composition an agent that delays absorption, for example, aluminum monostearate and gelatin.

Sterile injectable solutions can be prepared by incorporating the pharmaceutical composition in the required amount in an appropriate solvent with one or a combination of ingredients enumerated above, as required, followed by filtered sterilization. Generally, dispersions are prepared by incorporating the pharmaceutical composition into a sterile vehicle that contains a basic dispersion medium and the required other ingredients from those enumerated above.

The pharmaceutical composition can be orally administered, for example, with an inert diluent or an assimilable edible carrier. The pharmaceutical composition and other ingredients can also be enclosed in a hard or soft-shell gelatin capsule, compressed into tablets, or incorporated directly into the subject's diet. For oral therapeutic administration, the pharmaceutical composition can be incorporated with excipients and used in the form of ingestible tablets, buccal tablets, troches, capsules, elixirs, suspensions, syrups, wafers, and the like. Such compositions and preparations should contain at least 1% by weight of active compound. The percentage of the compositions and preparations can, of course, be varied and can conveniently be between about 5% to about 80% of the weight of the unit. The tablets, troches, pills, capsules, and the like can also contain the following: a binder, such as gum tragacanth, acacia, corn starch, or gelatin; excipients such as dicalcium phosphate; a disintegrating agent, such as corn starch, potato starch, alginic acid, and the like; a lubricant, such as magnesium stearate; and a sweetening agent, such as sucrose, lactose or saccharin, or a flavoring agent such as peppermint, oil of wintergreen, or cherry flavoring. When the dosage unit form is a capsule, it can contain, in addition to materials of the above type, a liquid carrier. Various other materials can be present as coatings or to otherwise modify the physical form of the dosage unit. For instance, tablets, pills, or capsules can be coated with shellac, sugar, or both. A syrup or elixir can contain the agent, sucrose as a sweetening agent, methyl and propylparabens as preservatives, a dye, and flavoring, such as cherry or orange flavor. Of course, any material used in preparing any dosage unit form should be pharmaceutically pure and substantially non-toxic in the amounts employed. In addition, the pharmaceutical composition can be incorporated into sustained-release preparations and formulations.

Thus, a pharmaceutically acceptable carrier can include solvents, dispersion media, coatings, antibacterial and antifungal agents, isotonic and absorption delaying agents, and the like. In some cases, the use of such media and agents for pharmaceutically active substances is well known in the art. Except insofar as any conventional media or agent is incompatible with the pharmaceutical composition, use thereof in the therapeutic compositions and methods of treatment is contemplated. Supplementary active compounds can also be incorporated into the compositions.

In some embodiments, it can be especially advantageous to formulate parenteral compositions in dosage unit form for ease of administration and uniformity of dosage. Dosage unit form as used herein, refers to physically discrete units suited as unitary dosages for the subject to be treated; each unit containing a predetermined quantity of pharmaceutical composition can be calculated to produce the desired therapeutic effect in association with the required pharmaceutical carrier. The specification for the dosage unit forms of the disclosure are related to the characteristics of the pharmaceutical composition and the particular therapeutic effect to be achieve. The principal pharmaceutical composition is compounded for convenient and effective administration in effective amounts with a suitable pharmaceutically acceptable carrier in an acceptable dosage unit. In the case of compositions containing supplementary active ingredients, the dosages are determined by reference to the usual dose and manner of administration of the said ingredients.

For topical formulations, the base composition can be prepared with any solvent system, such as those Generally Regarded as Safe (GRAS) by the U.S. Food & Drug Administration (FDA). GRAS solvent systems include many short chain hydrocarbons, such as butane, propane, n-butane, or a mixture thereof, as the delivery vehicle, which are approved by the FDA for topical use. The topical compositions can be formulated using any dermatologically acceptable carrier. Exemplary carriers include a solid carrier, such as alumina, clay, microcrystalline cellulose, silica, or talc; and/or a liquid carrier, such as an alcohol, a glycol, or a water-alcohol/glycol blend. The compounds may also be administered in liposomal formulations that allow compounds to enter the skin. Such liposomal formulations are described in U.S. Pat. Nos. 5,169,637; 5,000,958; 5,049,388; 4,975,282; 5,194,266; 5,023,087; 5,688,525; 5,874,104; 5,409,704; 5,552,155; 5,356,633; 5,032,582; 4,994,213; and PCT Publication No. WO 96/40061. Examples of other appropriate vehicles are described in U.S. Pat. Nos. 4,877,805, 4,980,378, 5,082,866, 6,118,020 and EP Publication No. 0586106A1. Suitable vehicles of the disclosure may also include mineral oil, petrolatum, polydecene, stearic acid, isopropyl myristate, polyoxyl 40 stearate, stearyl alcohol, or vegetable oil.

Topical compositions can be provided in any useful form. For example, the compositions of the disclosure may be formulated as solutions, emulsions (including microemulsions), suspensions, creams, foams, lotions, gels, powders, balm, or other typical solid, semi-solid, or liquid compositions used for application to the skin or other tissues where the compositions may be used. Such compositions may contain other ingredients typically used in such products, such as colorants, fragrances, thickeners, antimicrobials, solvents, surfactants, detergents, gelling agents, antioxidants, fillers, dyestuffs, viscosity-controlling agents, preservatives, humectants, emollients (e.g., natural or synthetic oils, hydrocarbon oils, waxes, or silicones), hydration agents, chelating agents, demulcents, solubilizing excipients, adjuvants, dispersants, skin penetration enhancers, plasticizing agents, preservatives, stabilizers, demulsifiers, wetting agents, sunscreens, emulsifiers, moisturizers, astringents, deodorants, and optionally including anesthetics, anti-itch actives, botanical extracts, conditioning agents, darkening or lightening agents, glitter, humectants, mica, minerals, polyphenols, silicones or derivatives thereof, sunblocks, vitamins, and phytomedicinals.

In some formulations, the composition can be formulated for ocular application. For example, a pharmaceutical formulation for ocular application can include a polynucleotide construct as described herein in an amount that is, e.g., up to 99% by weight mixed with a physiologically acceptable ophthalmic carrier medium such as water, buffer, saline, glycine, hyaluronic acid, mannitol, and the like. For ophthalmic delivery, a polynucleotide construct as described herein may be combined with ophthalmologically acceptable preservatives, co-solvents, surfactants, viscosity enhancers, penetration enhancers, buffers, sodium chloride, or water to form an aqueous, sterile ophthalmic suspension or solution. Ophthalmic solution formulations may be prepared by dissolving the polynucleotide construct in a physiologically acceptable isotonic aqueous buffer. Further, the ophthalmic solution may include an ophthalmologically acceptable surfactant to assist in dissolving the inhibitor. Viscosity building agents, such as hydroxymethyl cellulose, hydroxyethyl cellulose, methylcellulose, polyvinylpyrrolidone, or the like may be added to the compositions of the disclosure to improve the retention of the compound.

Topical compositions can be delivered to the surface of the eye, e.g., one to four times per day, or on an extended delivery schedule such as daily, weekly, bi-weekly, monthly, or longer, according to the routine discretion of a skilled clinician. The pH of the formulation can range from about pH 4-9, or about pH 4.5 to pH 7.4.

For nucleic acid constructs of the disclosure, suitable pharmaceutically acceptable salts include (i) salts formed with cations such as sodium, potassium, ammonium, magnesium, calcium, polyamines such as spermine and spermidine, etc.; (ii) acid addition salts formed with inorganic acids, for example hydrochloric acid, hydrobromic acid, sulfuric acid, phosphoric acid, nitric acid and the like; (iii) salts formed with organic acids such as, for example, acetic acid, oxalic acid, tartaric acid, succinic acid, maleic acid, fumaric acid, gluconic acid, citric acid, malic acid, ascorbic acid, benzoic acid, tannic acid, palmitic acid, alginic acid, polyglutamic acid, naphthalenesulfonic acid, methanesulfonic acid, p-toluenesulfonic acid, naphthalenedisulfonic acid, polygalacturonic acid, and the like; and (iv) salts formed from elemental anions such as chlorine, bromine, and iodine.

The disclosure provides methods for treating a subject with a cancer or suspected of having a cancer comprising administering a drug-like peptide of the disclosure (see, Table 1) comprising a therapeutically effective amount of one or more drug-like peptide and optionally one or more anticancer agents disclosed herein. A therapeutically effective amount can be measured as the amount sufficient to prevent cancer cells from dividing, metastasizing and/or growing, ultimately killing the cancer cells or reducing the metastatic potential of the cancer cell. Generally, the optimal dosage of will depend upon the type and stage of the cancer and factors such as the weight, sex, and condition of the subject. Nonetheless, suitable dosages can readily be determined by one skilled in the art. Typically, dosages used in vitro may provide useful guidance in the amounts useful for in situ administration of the pharmaceutical composition, and animal models may be used to determine effective dosages for treatment of specific cancers. Various considerations are described, e.g., in Langer, Science, 249: 1527, (1990); Gilman et al. (eds.) (1990), each of which is herein incorporated by reference. Typically, a suitable dosage can be 1 to 1000 mg/kg body weight, e.g., 10 to 500 mg/kg body weight. In a particular embodiment, a drug-like peptide disclosed herein can be administered at dosage of 1 mg/kg, 2 mg/kg, 3 mg/kg, 4 mg/kg, 5 mg/kg, 6 mg/kg, 7 mg/kg, 8 mg/kg, 9 mg/kg, 10 mg/kg, 20 mg/kg, 30 mg/kg, 40 mg/kg, 50 mg/kg, 60 mg/kg, 70 mg/kg, 80 mg/kg, 90 mg/kg, 100 mg/kg, 110 mg/kg, 120 mg/kg, 130 mg/kg, 140 mg/kg, 150 mg/kg, 160 mg/kg, 170 mg/kg, 180 mg/kg, 190 mg/kg, 200 mg/kg, 210 mg/kg, 220 mg/kg, 230 mg/kg, 250 mg/kg, 300 mg/kg, 350 mg/kg, 400 mg/kg, 450 mg/kg, 500 mg/kg, 550 mg/kg, 600 mg/kg, 650 mg/kg, 700 mg/kg, 750 mg/kg, 800 mg/kg, 850 mg/kg, 900 mg/kg, 950 mg/kg, 100 mg/kg, or a range that includes or is between any two of the foregoing dosages, including fractional dosages thereof.

Examples, of anticancer agents that can be used with the drug-like peptides disclosed herein include, but are not limited to, alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and tiimethylolomelamine; acetogenins (e.g., bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; vinca alkaloids; epipodophyllotoxins; antibiotics such as the enediyne antibiotics (e.g., calicheamicin, especially calicheamicin gammall and calicheamicin omegall; L-asparaginase; anthracenedione substituted urea; methyl hydrazine derivatives; dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogs such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitiaerine; pentostatin; phenamet; pirarubicin; losoxantione; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2 2"-trichlorotiiethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® (docetaxel) (Rhone-Poulenc Rorer, Antony, France); chloranbucil; GEMZAR® (gemcitabine); 6-thioguanine; mercaptopurine; methotrexate; platinum coordination complexes such as cisplatin, oxaliplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (e.g., CPT-11); topoisomerase inhibitor RFS 2000; difluoromethylornithine (DFMO); retinoids such as retinoic acid; capecitabine; leucovorin (LV); irenotecan; adrenocortical suppressant; adrenocorticosteroids; progestins; estrogens; androgens; gonadotropin-releasing hormone analogs; and pharmaceutically acceptable salts, acids or derivatives of any of the above. Also included anticancer agents are anti-hormonal agents that act to regulate or inhibit hormone action on tumors such as anti-estrogens and selective estrogen receptor modulators (SERMs), including, for example, tamoxifen (including NOLVADEX® tamoxifen), raloxifene, droloxifene, 4-hydroxytamoxifen, trioxifene, keoxifene, LY117018, onapristone, and FARESTON-toremifene; aromatase inhibitors that inhibit the enzyme aromatase, which regulates estrogen production in the adrenal glands, such as, for example, 4(5)-imidazoles, aminoglutethimide, MEGASE® megestrol acetate, AROMASL® exemestane, formestanie, fadrozole, RIVISOR® vorozole, FEMARA® letrozole, and ARTMIDEX® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Ralf and H-Ras; ribozymes such as a VEGF-A expression inhibitor (e.g., ANGIOZYME® ribozyme) and a HER2 expression inhibitor; vaccines such as gene therapy vaccines, for example, ALLOVECTIN® vaccine, LEUVECTIN® vaccine, and VAXID® vaccine; PROLEUKIN® rJL-2; LURTOTECAN® topoisomerase 1 inhibitor; ABARELLX® rmRH; antibodies such as trastuzumab and pharmaceutically acceptable salts, acids or derivatives of any of the above. In a particular embodiment, the disclosure provides for combined therapy comprising one or more drug-like peptides disclosed herein used in combination with a tyrosine kinase inhibitor (TKI). Examples of protein kinase inhibitors, include but are not limited to, adavosertib, afatinib, axitinib, bosutinib, cetuximab, cobimetinib, crizotinib, cabozantinib, dasatinib, entrectinib, erdafitinib, erlotinib, fostamatinib, gefitinib, ibrutinib, imatinib, lapatinib, lenvatinib, mubritinib, nilotinib, pazopanib, pegaptanib, ruxolitinib, sorafenib, sunitinib, SU6656, vandetanib, and vemurafenib. In another embodiment, the disclosure provides for combined therapy comprising one or more drug-like peptides disclosed herein used in combination with an angiogenesis inhibitor. Examples of angiogenesis inhibitors, include but are not limited to, axitinib, bevacizumab, cabozantinib, everolimus, lenalidomide, lenvatinib mesylate, pazopanib, ramucirumab, regorafenib, sorafenib, sunitinib, thalidomide, vandetanib, and Ziv-aflibercept. In another embodiment, the disclosure provides for combined therapy comprising one or more drug-like peptides disclosed herein used in combination with a PARP inhibitor. Examples of PARP inhibitors, include but are not limited to, olaparib, niraparib, rucaparib, and talzoparib. The anticancer agent may be administered, by a route and in an amount commonly used therefore, simultaneously (at the same time or in the same formulation) or sequentially with a drug-like peptide as disclosed herein. When a drug-like peptide as disclosed herein is used contemporaneously with one or more anticancer agents, a pharmaceutical composition containing the one or more anticancer agents in addition to a drug-like peptide disclosed herein may be utilized but may not be required. Accordingly, the pharmaceutical compositions disclosed herein include those that also contain one or more anticancer agents in addition to a drug-like peptide disclosed herein.

Provided herein can be peptides or salts thereof and compositions comprising the same. Peptides can be of any length. In some cases, a peptide can have a sequence length from: about 5 amino acids to about 80 amino acids, about 5 amino acids to about 20 amino acids, about 10 amino acids to about 40 amino acids, about 20 amino acids to about 60 amino acids, about 20 amino acids to about 50 amino acids, or about 40 amino acids to about 80 amino acids. In some cases, a peptide or salt thereof can have a sequence length of less than about: 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 amino acids. In some cases, a peptide can have a sequence length of more than about: 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 amino acids.

In some cases, peptides provided herein can comprise at least partial sequence identity to wildtype proteins. In some cases, peptides provided herein can comprise mutations as compared to a wildtype peptide sequence. In some cases, a peptide provided herein can comprise a continuous sequence having from about 7-17, 7-15, 7-10, 8-17, 8-15, 8-10, 9-17, 9-15, or 9-10 residues identical to a sequence provided in any one of SEQ ID NO: 1-9489 or a polypeptide recited in SEQ ID NO: 9521, 9522, 9526, 9530, or 9531. In some cases, at least a contiguous portion of the peptide or salt thereof can comprise a sequence with at least about: 70%, 75%, 80%, 85%, 90%, 91%, 92%, 93%, 94%, 95%, 96%, 97%, 98%, 99%, or 100% sequence identity to a polypeptide recited in SEQ ID NO: 1-9489. In some cases, a peptide or salt thereof can comprise a sequence with at least about: 70%, 75%, 80%, 85%, 90%, 91%, 92%, 93%, 94%, 95%, 96%, 97%, 98%, 99%, or 100% sequence identity to a polypeptide recited in SEQ ID NO: 9521, 9522, 9526, 9530, 9531 or 9701. In some cases, a peptide provided herein comprises less than about 10, 9, 8, 7, 6, 5, 4, 3, 2, or 1 residue difference to a polypeptide provided in any one of SEQ ID NO: 1-9489. In some cases, a peptide comprises 70%, 75%, 80%, 85%, 90%, 91%, 92%, 93%, 94%, 95%, 96%, 97%, 98%, 99%, or 100% sequence identity to the polypeptide of SEQ ID NO 9530.

In some embodiments, a peptide or salt thereof can modulate expression level of a target protein. In some cases, a target protein can be implicated in a disease or condition. Non-limiting examples of suitable genes that can encode a target protein are provided in Table 7.

In some instances, a target protein can comprise an enzyme or fragment thereof. In some instances, a target protein can comprise, a kinase, a phosphatase, a signaling peptide, a transcription factor, or any combination thereof. In some cases, a target protein can comprise an oxidoreductase, a hydrolase, a transferase, a lyase, an isomerase, or a ligase. In some cases, a target protein can be encoded by a gene in Table 7 or a variant of a gene in Table 7 or a fragment of any of these. Table 7 comprises non-limiting exemplary genes that can encode for a target protein.

In some cases, a peptide or salt thereof can modulate a target protein. Modulation of a target protein by a peptide or salt thereof can comprise at least a partial inhibition, reduction, or total elimination of activity. In some cases, modulation can comprise at least a partial increase in activity. In some cases, modulation can be achieved by at least partially inhibiting or activating protein to protein interaction. In some cases, a protein to protein interaction can comprise a ligand to receptor interaction. In some instances, a protein to protein interaction can comprise a regulatory protein complex. In some cases, a peptide or salt thereof can at least partially reduce a protein to nucleic acid interaction.

TABLE 7

| Exemplary genes that encode exemplary target proteins: | | | |
|---|---|---|---|
| MCL-1 | CRLF2 | PCDH15 | POMGNT1 |
| BCR | DSE | PTGFR | RYR2 |
| BRAF | EXT1 | SGCD | STAG2 |
| JAK1 | FMR1 | TMEM127 | GNAQ |
| JAK2 | AKAP9 | HSPH1 | KDR |
| VEGF | ATRX | LRPPRC | MITF |
| EGFR | CBS | MYC | NOTCH1 |
| ALK | CRTAP | PCGF2 | POMT1 |
| CDK1 | DSG2 | PTPN11 | S1PR2 |
| CDK2 | EXT2 | SGSH | STAR |
| CDK3 | FUBP1 | TMEM43 | GNAS |
| CDK3 | AKT1 | IDH1 | KEAP1 |
| CDK4 | AXIN1 | LRRK2 | MKS1 |
| BRCA | CCDC178 | MYD88 | NOTCH2 |
| PIK3CA | CRYAB | PDE11A | POU1F1 |
| MEK | DSP | PTPN12 | SAMD9L |
| C-KIT | EYA4 | SH2B3 | STK11 |
| NRAS | FZD3 | TMEM67 | GNPTAB |
| ABCB11 | AKT2 | IDH2 | KIF1B |
| ANTXR2 | AXIN2 | LYST | MLH1 |
| BCOR | CCNE1 | MYH6 | NPC1 |
| CDKN1B | CSF1R | PDGFRA | POU6F2 |
| CYP27A1 | DTNA | RAC1 | SBDS |
| EMD | EZH2 | SLC25A4 | SUFU |
| FANCF | G6PC | TMPO | GPC3 |
| ABCC8 | ALB | IGF2R | KIT |
| APC | BAG3 | MAP2K1 | MLH3 |
| BCORL1 | CD79A | MYH7 | NPC2 |

TABLE 7-continued

| Exemplary genes that encode exemplary target proteins: | | | |
|---|---|---|---|
| CDKN2A | CSMD3 | PDHA1 | PPM1L |
| CYP27B1 | ECT2L | RAD21 | SCN11A |
| EP300 | F11 | SLC26A2 | SUZ12 |
| FANCG | GAA | TNFAIP3 | GPC6 |
| ABCC9 | ALDH3A2 | IGHMBP2 | KLF6 |
| AR | BAI3 | MAP2K2 | MMAB |
| BLM | CD79B | MYL2 | NPHP1 |
| CEP290 | CSRP3 | PDZRN3 | PPP2R1A |
| DAXX | EDA | RAD50 | SCN5A |
| EPCAM | F5 | SLC37A4 | SYNE3 |
| FANCI | GABRA6 | TNFRSF14 | GPR78 |
| ABCD1 | ALDOB | IGSF10 | KLHDC8B |
| ARID1A | BAP1 | MAP2K4 | MPL |
| BMPR1A | CD96 | MYL3 | NPHP4 |
| CFTR | CTNNB1 | PEX1 | PPT1 |
| DBT | EDN3 | RAD51B | SCNN1A |
| EPHA5 | FAH | SLC7A8 | TAZ |
| FANCL | GALNT12 | TNNC1 | GRIN2A |
| ABL1 | ALK | IKBKAP | KMT2A |
| ARID2 | BARD1 | MAP3K1 | MPZ |
| RAFI | CDC27 | MYLK2 | NPM1 |
| CHEK1 | CTNS | PEX7 | PRDM1 |
| DCC | EDNRB | RAD51C | SCNN1B |
| EPHB2 | FAM46C | SLC9A9 | TBX20 |
| FANCM | GALT | TNNI3 | GRM8 |
| ACADM | ALS2 | IKZF1 | KMT2C |
| ARSA | BAX | MAP4K3 | MRE11A |
| BRCA1 | CDC73 | MYO1B | PRKAG2 |
| CHEK2 | CTSK | PHF6 | SCNN1G |
| DCX | EED | RAD51D | TCAP |
| ERBB2 | FANCA | SLX4 | GXYLT1 |
| FAS | GATA1 | TNNT1 | KMT2D |
| CADS | AMER1 | IKZF4 | MSH2 |
| ASAH1 | BAZ2B | MAP7 | NRCAM |
| BRCA2 | CDH1 | MYO7A | PRKAR1A |
| CHM | CUBN | PIK3CA | SCO2 |
| DDB2 | EGFR | RARB | TCERG1 |
| ERBB3 | FANCB | SMAD2 | H3F3A |
| FAT3 | GATA2 | TNNT2 | KRAS |
| ACADVL | AMPD1 | IL2RG | MSH3 |
| ASCC1 | BCKDHA | MAPK10 | NTRK1 |
| BRIP1 | CDH23 | MYOZ2 | PRKDC |
| CIC | CYLD | PIK3CG | SDHA |
| DDR2 | EGR2 | RB1 | TCF7L2 |
| ERBB4 | FANCC | SMAD4 | HADHA |
| FBXO11 | GATA3 | TP53 | KREMEN1 |
| ACTC1 | AMPH | IL6ST | MSH6 |
| ASL | BCKDHB | MAS1L | NUP62 |
| BTD | CDK12 | MYPN | PROC |
| CLN3 | CYP11A1 | PIK3R1 | SDHAF2 |
| DES | EHBP1 | RBM20 | TERT |
| ERCC2 | FANCD2 | SMARCA4 | HADHB |
| FBXO32 | GATAD1 | TPM1 | L1CAM |
| ACTN2 | ANTXR1 | IL7R | MSMB |
| ASPA | BCL6 | MAX | OR5L1 |
| BTK | CDK4 | NBN | PROP1 |
| CLN5 | CYP21A2 | PKHD1 | SDHB |
| DHCR7 | ELMO1 | RECQL4 | TET2 |
| ERCC3 | FANCE | SMARCB1 | HBB |
| FBXW7 | GBA | TPP1 | LAMA2 |
| ACVR1B | GCDH | INVS | MSR1 |
| ASS1 | JAK1 | MC1R | OTC |
| BUB1B | MDM2 | NCOA3 | PRPF40B |
| CLN6 | NEK2 | PKP2 | SDHC |
| DICER1 | PLOD1 | RET | TFG |
| ERCC4 | ROS1 | SMC1A | HESX1 |
| FGD4 | SMPD1 | TRAF5 | LAMA4 |
| ADA | GJB2 | IRAK4 | MTAP |
| ASXL1 | JAK2 | MCCC2 | OTOP1 |
| CALR3 | MECP2 | NCOR1 | PRX |
| CLN8 | NEXN | PLEKHG5 | SDHD |
| DIS3L2 | PLP1 | RHBDF2 | TGFB3 |
| ERCC5 | RPGRIP1L | SMC3 | HEXA |
| FGFR1 | SOX10 | TRIO | LAMP2 |
| ADAMTS13 | GLA | ITCH | MTHFR |
| ATM | JAK3 | MCOLN1 | PAH |
| CARD11 | MED12 | NDUFA13 | PSAP |
| COL1A2 | NF1 | PLN | SEPT9 |

TABLE 7-continued

| Exemplary genes that encode exemplary target proteins: | | | |
|---|---|---|---|
| DKC1 | PMP22 | RNASEL | TGFBR1 |
| ERCC6 | RS1 | SMO | HEXB |
| FGFR2 | SOX2 | TRPV4 | LDB3 |
| ADAMTS2 | GLB1 | TRRAP | MTM1 |
| ATP4A | JUP | U2AF1 | PALB2 |
| CASP8 | MEFV | USH1C | PSEN1 |
| COL4A3 | NF2 | WAS | SETBP1 |
| DLD | PMS2 | WWP1 | TGFBR2 |
| ERRFI1 | RSPO1 | ZIC3 | HFE |
| FGFR3 | SPEG | TSC1 | LEPRE1 |
| AGA | GLI1 | U2AF2 | MTOR |
| ATP6V0D2 | KAT6A | USH1G | PALLD |
| CAV3 | MEN1 | WBSCR17 | PSEN2 |
| COL4A4 | NFE2L2 | XPA | SETD2 |
| DMD | POLD1 | ZNF2 | THSD7B |
| ESCO2 | RTEL1 | TSC2 | HGSNAT |
| FH | SPOP | UBA1 | LIG4 |
| AGL | GLI3 | USP16 | MUC16 |
| ATP7A | KCNQ1 | WEE1 | PAX5 |
| CBFB | MET | XPC | PTCH1 |
| COL7A1 | NFKBIA | ZNF226 | SF1 |
| DNAJB2 | POLE | TSHB | TINF2 |
| ESR1 | RUNX1 | UBR3 | HIST1H3B |
| FKTN | SRC | USP25 | LMNA |
| AGPS | GLMN | WNK2 | MUT |
| ATP7B | KDM4B | XRCC3 | PAX6 |
| CBL | MFSD8 | ZNF473 | PTCH2 |
| COX15 | NIPA2 | TSHR | SF3A1 |
| DNMT3A | POLH | UROD | TMC6 |
| ETV6 | RUNX1T1 | VCL | HNF1A |
| FLCN | SSTR1 | WRN | LPAR2 |
| AHI1 | GNA11 | ZBED4 | MUTYH |
| ATP8B1 | KDM6A | ZNF595 | PBRM1 |
| CBLB | MIER3 | TTN | PTEN |
| CREBBP | NKX3-1 | UROS | SF3B1 |
| DSC2 | AIP | VHL | TMC8 |
| EXOC2 | ATR | WT1 | HRAS |
| FLT3 | CBLC | ZFHX3 | LRP1B |
| ARAF | ZRSR2 | HER2 | MYBPC3 |

In some cases, modulation of expression level can be determined using an in vitro assay. In some cases, modulation of activity can be measured relative to an amount of the target protein or activity by a target protein in a cell that has not been treated with a peptide or salt thereof. In some cases, an assay can be utilized to measure kinase activity or phosphatase activity of a target protein. In some cases, kinase or phosphatase activity can be determined by evaluating activity of proteins downstream from the target protein. Downstream proteins can comprise proteins that can interact with a target protein directly or indirectly. In some cases, a downstream protein is at least about 1, 2, 3, 4, 5, 6, 7, 8, 9, or up to 10 proteins removed from the target protein in a pathway of a cell.

Any in vitro assay can be utilized in a method provided herein. In some cases, an in vitro assay comprises a Western blot, PCR, RNA sequencing, Northern blot, qPCR, ELISA, flow cytometry, fluorescence staining, and any combination thereof.

In some cases, a peptide or salt thereof can produce an at least partial increase or an at least partial decrease of an activity of a downstream protein. Any downstream protein of any target protein provided herein can be evaluated, for example downstream proteins of any proteins encoded by the genes in Table 7. In some cases, a target protein is RAF1. In some instances, a downstream protein of Raf1 can comprise MEK1/2, ERK1/2, AP-1 or any combination thereof. In some cases, a target protein comprises EGFR. In some cases, a downstream protein of EGFR can comprise NcK, PAK, PI3K, Ras or any combination thereof. In some instances, a downstream protein of EGFR can comprise a pathway such as proteins that comprise the PI3K pathway which can include PDK-1, Akt, mTOR, and S6K. Another example of a downstream protein pathway for EGFR can be the Pak pathway which can comprise NcK, MKK3/6, JNK, P38, c-Fos, and c-Jun. In some cases, a downstream protein can comprise a transcriptional regulator such as STATS.

In some cases, a peptide of salt thereof can have anti-cancer activity. Anti-cancer activity can refer to reduction or elimination of cancer. In some cases, anti-cancer activity can comprise killing of a cancer cell. Anti-cancer activity can be determined in vivo or in vitro. In some cases, a cancer cell, such as a cancer cell line can be utilized. Suitable cancer cells for use in methods provided herein can comprise in vitro cell lines or primary cancer cells. In some cases, a peptide or salt thereof can modulate an expression level of a target protein. Modulation can be determined utilizing an assay or mouse model to determine a level of killing of a cancer cell.

In some cases, provided herein can be partial increases or partial decreases of an activity of a target protein. Increases or decreases can refer to at least about a 1-fold, 2-fold, 3-fold, 4-fold, 5-fold, 6-fold, 7-fold, 8-fold, 9-fold, 10-fold, 15-fold, 20-fold, 30-fold, 50-fold, 100-fold, 150-fold, 175-fold, 200-fold, 250-fold, 300-fold, 400-fold, 500-fold, 800-fold, or up to about 1000-fold change in an activity as compared to a comparable method that lacks treatment with a peptide or salt thereof. In some cases, a partial increase or a partial decrease can refer to about: 1%, 5%, 10%, 20%, 40%, 60%, 80%, 100%, 150%, 200%, 250%, 300%, 350%, 400%, or up to about a 500% increase or decrease in an activity of a target protein. In some embodiments, a peptide or salt thereof can comprise independently Gly, or an amino acid comprising a $C_1$-$C_{10}$ alkyl, a $C_1$-$C_{10}$ alkenyl, a $C_1$-$C_{10}$ alkynyl, a cycloalkyl, or an alkylcycloalkyl side chain. In some cases, a peptide can comprise an amino acid comprising an aromatic side chain. In some cases, a peptide can comprise an amino acid comprising a side chain that can be at least partially protonated or at least partially deprotonated at a pH of about 7.3. In some cases, an amino acid of the peptide or salt thereof positioned at an end terminus comprises a side chain that can be at least partially deprotonated at a pH of about 7.3. In some cases, a peptide can comprise an amino acid comprising an amide containing side chain. In some cases, a peptide can comprise an amino acid comprising an alcohol or thiol containing side chain. In some cases, a peptide or salt thereof can comprise a recombinant peptide.

In some embodiments, a peptide can be an engineered peptide. In some cases, a peptide can be a natural peptide, a synthetic peptide, an artificial peptide, a modified peptide, or any combination thereof. In some embodiments, a peptide can comprise a chemical modification, such as an acetylation, a sulfonation, an amidation, or an esterification. In some cases, a peptide can comprise a stapled peptide or salt thereof, a stitched peptide or salt thereof, a macrocyclic peptide or salt thereof, or any combination thereof. In some instances, a stapled peptide can comprise a covalent linkage between two amino acid side-chains. In some instances, a stapled peptide can comprise an alpha-helix. A stitched peptide or salt thereof can comprise multiple staples, for example a stitched peptide can comprise a plurality of covalent linkages between different amino acid side-chains on a peptide. In some cases, a macrocyclic peptide can comprise a ring structure, or a bicyclic structure. In some instances, a macrocyclic peptide can comprise a head-to-tail, a side-chain-to-side-chain, or both, structure.

In some embodiments, a peptide provided herein can further comprise a linker. A linker can provide desirable flexibility to permit the desired expression, activity and/or conformational positioning of a peptide. A linker can be of any appropriate length and is preferably designed to be sufficiently flexible so as to allow the proper folding and/or function and/or activity of one or both of the domains it connects. In some cases, a linker can have a length of at least 3, 5, 10, 15, 20, 25, 30, 35, 40, 45, 50, 55, 60, 65, 70, 75, 80, 85, 90, 95, or 100 residues. In some embodiments, a linker has a length from about 0 to 200 residues, from about 10 to 190 residues, from about 20 to 180 residues, from about 30 to 170 residues, from about 40 to 160 residues, from about 50 to 150 residues, from about 60 to 140 residues, from about 70 to 130 residues, from about 80 to 120 residues, or from about 90 to 110 residues. In some embodiments, a linker can comprise an endogenous protein sequence. In some embodiments, a linker sequence comprises glycine, alanine, or serine amino acid residues, or any combination of glycine, alanine, and serine amino acid residues. In some embodiments, a linker can contain motifs, e.g., multiple or repeating motifs, of GS, GGS, GGGGS, GGSG, or SGGG. In some cases, a linker sequence can include any naturally occurring amino acids, non-naturally occurring amino acids, or combinations thereof. In some cases, a linker can be a cleavable linker. In some cases, a linker can at least in part be resistant to cleavage. In some cases, a resistant cleavage linker can comprise a thioether linker, a maleimide alkane linker, a maleimide cyclohexane linker, or any combination thereof. In some cases, a cleavable linker can comprise an enzymatically cleavable linker, a chemically cleavable linker, or both. A cleavable linkage can comprise an acid-labile linker, a reducible linker, a disulfide-linker, a hydrazone linker, a peptide linker, or any combination thereof. In some cases, a cleavable linker can be linked to an antibody or a fragment thereof. In some cases, a cleavable linker can be linked to a cell penetrating peptide. In some cases, a peptide can be directly or indirectly linked to a cell penetrating peptide. A cell penetrating peptide can be a short polypeptide that can allow for increased uptake of a subject composition into a cell. A cell penetrating peptide can be cationic, amphipathic, hydrophobic, and combinations thereof. In some instances, a cell penetrating peptide can comprise a TAT peptide, a MPG peptide, a Pep-1 peptide, a KALA peptide, a SV40 NLS peptide, an Arg polypeptide, a TfR targeting peptide, a rabies virus glycoprotein, or a penetratin peptide. A cell penetrating peptide can be of any length. In some cases, a cell penetrating peptide can be about 3 amino acids to about 50 amino acids long, about 5 amino acids to about 15 amino acids long, about 10 amino acids to about 25 amino acids long, about 20 amino acids to about 30 amino acids long, or about 30 amino acids to about 50 amino acids long. In some cases, a cell penetrating peptide can comprise a peptide that comprises L-amino acids, D-amino acids, both L and D amino acids, and non-natural amino acids. In some cases, a cell penetrating peptide can comprise a cyclic peptide. In some instances, a cell penetrating peptide can comprise a poly-arginine stretch.

In some embodiments, a method provided herein can be utilized for screening. In some cases, a method can be used to screen genes or proteins encoded by genes for inhibitory or stimulatory activity. In some cases, a method can comprise expressing at least a fragment of a gene in a target cell. In some embodiments, a method of screening for at least partially reducing or at least partially increasing the activity of a target protein, a protein that may interact downstream with a target protein, or both can comprise expressing one or more fragments of a gene in a target cell. In some cases, a gene fragment can be expressed from a vector, such as a polynucleotide (e.g., a plasmid) or a viral vector comprising a nucleic acid encoding the gene fragment. In some instances, a gene fragment can comprise at least a portion of a target protein. In some cases, a gene fragment can be from: about 20 nucleotides to about 1000 nucleotides, about 20 nucleotides to about 100 nucleotides, about 100 nucleotides to about 500 nucleotides, about 60 nucleotides to about 150 nucleotides, or about 500 nucleotides to about 1000 nucleotides in length. In some cases, a method of at least partially reducing the activity of a target protein or at least partially reducing the activity of a protein that interacts downstream with a target protein can comprise measuring the at least partial reduction of activity by determining a change in gene expression of a treated cell relative to the level of a gene expression in an untreated cell in an in vitro assay. In some cases, a method of screening for at least partially reducing or at least partially increasing the activity of a target protein, a protein that may interact downstream with a target protein, or both can comprise measuring the at least partial reduction of activity by determining a change in gene expression of a treated cell relative to the level of a gene expression in an untreated cell in an in vitro assay. In some cases, a change in gene expression can be determined by quantitative reverse transcriptase polymerase chain reaction, RNA-seq or both. In some instances, a target protein can be selected from a protein encoded by a gene or a variant thereof recited in Table 7. In some cases, a fragment of a gene can encode for a polypeptide comprising a sequence having at least about: 70%, 75%, 80%, 85%, 90%, 95%, 98%, or 99% sequence homology to any one of the peptides of SEQ ID Nos: 1-9489. In some cases, a vector or plasmid can be transfected, electroporated, or transduced into the target cell. In some cases, at least a portion of the target protein can comprise about: 5 amino acids to about 80 amino acids, 5 amino acids to about 20 amino acids, 10 amino acids to about 40 amino acids, 20 amino acids to about 60 amino acids, 20 amino acids to about 50 amino acids, or about 40 amino acids to about 80 amino acids. In some instances, reduction of activity can comprise reduced cell growth.

In some cases, a pharmaceutical composition can comprise a nucleic acid at least partially encoding a peptide described herein. In some cases, a nucleic acid can at least partially encode a peptide that can have at least about: 70%, 75%, 80%, 85%, 90%, 95% or 99% sequence identity to a polypeptide of SEQ ID NO: 1-9489. In some cases, the peptide may not comprise more than: about 10 amino acids to about 60 amino acids, about 10 amino acids to about 20 amino acids, about 20 amino acids to about 30 amino acids, about 30 amino acids to about 40 amino acids, about 40 amino acids to about 50 amino acids, or about 50 amino acids to about 60 amino acids. In some instances, a nucleic acid can comprise a pharmaceutical composition in unit dose form. In some cases, a nucleic acid can comprise DNA, RNA, or both. In some cases, a nucleic acid can be circular, such as a plasmid. A nucleic acid can be single stranded, double stranded, or both.

In some cases, a pharmaceutical composition can comprise a vector. A vector can comprise or can encode for a peptide described herein, for example a peptide for use in a pharmaceutical composition. In some instances, a vector can comprise a nucleic acid. In some cases, a vector can comprise a polypeptide coat. In some cases, a vector can be a viral vector, a virus-like particle. In some cases, the vector can comprise an RNA viral vector which can include but may not be limited to a retrovirus, lentivirus, coronavirus, alphavirus, flavivirus, rhabdovirus, morbillivirus, picornavirus, coxsackievirus, or picornavirus or portions of any of these, or fragments of any of these, or any combination thereof. In some cases, a vector can comprise a lentiviral vector. In some cases, a vector can comprise a DNA viral vector which can include but may not be limited to an adeno-associated viral (AAV) vector, adenovirus, hybrid adenoviral system, hepadnavirus, parvovirus, papillomavirus, polyomavirus, herpesvirus, poxvirus, a portion of any of these, or a fragment of any of these, or any combination thereof. In some cases, a vector can comprise an AAV vector. An AAV vector, can be of any serotype. In some cases, an AAV vector is of a serotype selected from any one of: AAV1, AAV2, AAV3, AAV4, AAV5, AAV6, AAV7, AAV8, AAV9, AAV10, AAV11, AAV12, AAVDJ, variants thereof, and any combination thereof. In some cases, a vector is of AAV2, AAV5, AAV9, or combinations thereof. Provided herein are also modified vectors that comprise mutations or modifications of components such as modified REP, CAP, ITRs, or combinations thereof. In some cases, chimeras of AAV vectors are also employed in methods and compositions provided herein.

Compositions provided herein can be delivered via any means. In some cases, composition is delivered via a vector. In some cases, a vector can comprise a polypeptide coat. In some cases, a vector can comprise a liposome, a nanoparticle, a microparticle, or any combination thereof. In some cases, a liposome can include but may not be limited to a unilamellar liposome, multilamellar liposome, archaeosome, noisome, novasome, cryptosome, emulsome, vesosome, or a derivative of any of these, or any combination thereof. In some cases, a vector comprises a nanoparticle. A nanoparticle, can include but may not be limited to a biopolymeric nanoparticle, an alginate nanoparticle, a xanthan gum nanoparticle, a cellulose nanoparticle, a dendrimer, a polymeric micelle, polyplexed, an inorganic nanoparticle, a nanocrystal, a metallic nanoparticle, a quantum dot, a protein nanoparticle, a polysaccharide nanoparticle, or a derivative of any of these, or any combination thereof.

Provided herein can also be a kit. A kit can comprise a pharmaceutical composition described herein, a nucleic acid described herein, a peptide described herein, a vector described herein or any combination thereof. In some cases, a kit can comprise instructions that recite the methods of using a pharmaceutical composition described herein, a nucleic acid described herein, a peptide described herein, the vector described herein or any combination thereof. In some cases, the kit can comprise instructions for administration to a subject in need thereof. In some embodiments, a kit can comprise a container, such as a plastic, a glass, or a metal container.

Also provided herein can be methods of making a pharmaceutical composition described herein. In some cases, the methods can comprise contacting a peptide or salt thereof with a pharmaceutically acceptable excipient, diluent or carrier.

In some embodiments, a pharmaceutical composition described herein can be administered in a therapeutically effective amount to a subject (e.g., a human) in need thereof to at least partially prevent or treat a disease or condition. In some cases, treating can comprise at least partially reducing or ameliorating at least one symptom of the disease or condition, such as reducing a growth of a tumor. The terms "treating," "treatment," and the like can be used herein to mean obtaining a desired pharmacologic effect, physiologic effect, or any combination thereof. In some instances, a treatment can reverse an adverse effect attributable to the disease or disorder. In some cases, the treatment can stabilize the disease or disorder. In some cases, the treatment can delay progression of the disease or disorder. In some instances, the treatment can cause regression of the disease or disorder. In some instances, the treatment can prevent the occurrence of the disease or disorder. In some embodiments, a treatment's effect can be measured. In some cases, measurements can be compared before and after administration of the composition. For example, a subject can have medical images prior to treatment compared to images after treatment to show cancer regression. In some instances, a subject can have an improved blood test result after treatment compared to a blood test before treatment. In some instances, measurements can be compared to a standard.

In some embodiments, a disease or condition can comprise cancer. In some cases, a cancer can comprise a sarcoma, a carcinoma, a melanoma, a lymphoma, a leukemia, a blastoma, a germ cell tumor, a myeloma, or any combination thereof. In some cases, cancer may comprise a thyroid cancer, adrenal cortical cancer, anal cancer, aplastic anemia, bile duct cancer, bladder cancer, bone cancer, bone metastasis, central nervous system (CNS) cancers, peripheral nervous system (PNS) cancers, breast cancer, Castleman's disease, cervical cancer, childhood Non-Hodgkin's lymphoma, lymphoma, colon and rectum cancer, endometrial cancer, esophagus cancer, Ewing's family of tumors (e.g. Ewing's sarcoma), eye cancer, gallbladder cancer, gastrointestinal carcinoid tumors, gastrointestinal stromal tumors, gestational trophoblastic disease, hairy cell leukemia, Hodgkin's disease, Kaposi's sarcoma, kidney cancer, laryngeal and hypopharyngeal cancer, acute lymphocytic leukemia, acute myeloid leukemia, children's leukemia, chronic lymphocytic leukemia, chronic myeloid leukemia, liver cancer, lung cancer, lung carcinoid tumors, Non-Hodgkin's lymphoma, male breast cancer, malignant mesothelioma, multiple myeloma, myelodysplastic syndrome, myeloproliferative disorders, nasal cavity and paranasal cancer, nasopharyngeal cancer, neuroblastoma, oral cavity and oropharyngeal cancer, osteosarcoma, ovarian cancer, pancreatic cancer, penile cancer, pituitary tumor, prostate cancer, retinoblastoma, rhabdomyosarcoma, salivary gland cancer, sarcoma (adult soft tissue cancer), melanoma skin cancer, non-melanoma skin cancer, stomach cancer, testicular cancer, thymus cancer, uterine cancer (e.g. uterine sarcoma), vaginal cancer, vulvar cancer, or Waldenstrom's macroglobulinemia.

In some cases, a cancer can include a hyperproliferative disorder. Hyperproliferative disorders can include but may not be limited to cancers, hyperplasia, or neoplasia. In some cases, the hyperproliferative cancer can be breast cancer such as a ductal carcinoma in duct tissue of a mammary gland, medullary carcinomas, colloid carcinomas, tubular carcinomas, and inflammatory breast cancer; ovarian cancer, including epithelial ovarian tumors such as adenocarcinoma in the ovary and an adenocarcinoma that has migrated from the ovary into the abdominal cavity; uterine cancer; cervical cancer such as adenocarcinoma in the cervix epithelial including squamous cell carcinoma and adenocarcinomas; prostate cancer, such as a prostate cancer selected from the following: an adenocarcinoma or an adenocarcinoma that has migrated to the bone; pancreatic cancer such as epitheloid carcinoma in the pancreatic duct tissue and an adenocarcinoma in a pancreatic duct; bladder cancer such as a transitional cell carcinoma in urinary bladder, urothelial carcinomas (transitional cell carcinomas), tumors in the urothelial cells that line the bladder, squamous cell carcinomas, adenocarcinomas, and small cell cancers; leukemia such as acute myeloid leukemia (AML), acute lymphocytic leukemia, chronic lymphocytic leukemia, chronic myeloid leukemia, hairy cell leukemia, myelodysplasia, myeloproliferative disorders, acute myelogenous leukemia (AML), chronic myelogenous leukemia (CML), mastocytosis, chronic lymphocytic leukemia (CLL), multiple myeloma (MM), and myelodysplastic syndrome (MDS); bone cancer; lung cancer such as non-small cell lung cancer (NSCLC), which may be divided into squamous cell carcinomas, adenocarcinomas, and large cell undifferentiated carcinomas, and small cell lung cancer; skin cancer such as basal cell carcinoma, melanoma, squamous cell carcinoma and actinic keratosis, which may be a skin condition that sometimes develops into squamous cell carcinoma; eye retinoblastoma; cutaneous or intraocular (eye) melanoma; primary liver cancer (cancer that begins in the liver); kidney cancer; autoimmune deficiency syndrome (AIDS)-related lymphoma such as diffuse large B-cell lymphoma, B-cell immunoblastic lymphoma and small noncleaved cell lymphoma; Kaposi's Sarcoma; viral-induced cancers including hepatitis B virus (HBV), hepatitis C virus (HCV), and hepatocellular carcinoma; human lymphotropic virus-type 1 (HTLV-1) and adult T-cell leukemia/lymphoma; and human papilloma virus (HPV) and cervical cancer; central nervous system (CNS) cancers such as primary brain tumor, which includes gliomas (astrocytoma, anaplastic astrocytoma, or glioblastoma multiforme), oligodendrogliomas, ependymomas, meningiomas, lymphomas, schwannomas, and medulloblastomas; peripheral nervous system (PNS) cancers such as acoustic neuromas and malignant peripheral nerve sheath tumors (MPNST) including neurofibromas and schwannomas, malignant fibrous cytomas, malignant fibrous histiocytomas, malignant meningiomas, malignant mesotheliomas, and malignant mixed MUllerian tumors; oral cavity and oropharyngeal cancer such as hypopharyngeal cancer, laryngeal cancer, nasopharyngeal cancer, and oropharyngeal cancer; stomach cancer such as lymphomas, gastric stromal tumors, and carcinoid tumors; testicular cancer such as germ cell tumors (GCTs), which include seminomas and nonseminomas, and gonadal stromal tumors, which include Leydig cell tumors and Sertoli cell tumors; thymus cancer such as to thymomas, thymic carcinomas, Hodgkin disease, non-Hodgkin lymphomas carcinoids or carcinoid tumors; rectal cancer; and colon cancer. In some cases, a cancer can comprise a malignant thyroid disorder such as for example a follicular carcinoma, a follicular variant of papillary thyroid carcinomas, a medullary carcinoma, or a papillary carcinoma.

In some cases, a disease or condition is not cancer. In some cases, a disease or condition is acute. In other cases, a disease or condition is chronic. Suitable diseases and conditions may affect adults or pediatric subjects. A disease or condition may affect the brain, eyes, lungs, liver, bladder, kidneys, heart, stomach, intestines, or combinations thereof. Non-limiting examples of diseases and conditions comprise: autoimmune, allergy, asthma, celiac, Chrohn's, colitis, heart disease, liver disease, kidney disease, lupus, rheumatoid arthritis, scleroderma, polychondritis, macular degeneration, schizophrenia, ataxia, myotonic dystrophy, Alzheimer's, Huntington's, Kennedy's, fragile X syndrome, Autism, Inflammation, ALS, drug addiction, hemophilia, thalassemia, factor X deficiency, anemia, SCID, neuropathy, cystic fibrosis, cirrhosis, osteoporosis, atrophy, diabetes, stroke, hepatitis, epilepsy, COPD, meningitis, metabolic disease, and combinations thereof.

In some embodiments, a subject may have been diagnosed with a disease or condition. In some cases, the subject may have been diagnosed prior to treating with a peptide or pharmaceutical composition thereof disclosed herein. In some cases, diagnosing a subject with a disease or condition can comprise diagnosing with a physical examination, a biopsy, a metabolite test, a radiological image, a blood test, a urine test, an antibody test, or any combination thereof. In some instances, a radiological image can comprise a computed tomography (CT) image, a nuclear scan, an X-Ray image, a magnetic resonance image (MRI), an ultrasound image, or any combination thereof.

In some embodiments, the method can comprise administering a second therapy. In some cases, a second therapy can comprise an antibiotic, an antiviral, a cancer treatment, a neurological treatment, a steroid, an anti-inflammatory treatment, or any combination thereof. In some instances, a second therapy can comprise surgery, chemotherapy, radiation therapy, immunotherapy, hormone therapy, a checkpoint inhibitor, targeted drug therapy, adoptive immunotherapy, anti-angiogenic agents, chimeric antigen receptor (CAR) T-cell therapy, gene editing therapy, a protein knockdown therapy, RNA editing therapy, or any combination thereof.

In some embodiments, a pharmaceutical composition can be in unit dose form. In some embodiments, compositions disclosed herein can be in unit dose forms or multiple-dose forms. Unit dose forms, as used herein, can refer to physically discrete units suitable for administration to human or non-human subjects (e.g., animals). In some cases, a nucleic acid or a peptide is present in a composition in a range of from about 1 mg to about 2000 mg; from about 5 mg to about 1000 mg, from about 10 mg to about 25 mg to 500 mg, from about 50 mg to about 250 mg, from about 100 mg to about 200 mg, from about 1 mg to about 50 mg, from about 50 mg to about 100 mg, from about 100 mg to about 150 mg, from about 150 mg to about 200 mg, from about 200 mg to about 250 mg, from about 250 mg to about 300 mg, from about 300 mg to about 350 mg, from about 350 mg to about 400 mg, from about 400 mg to about 450 mg, from about 450 mg to about 500 mg, from about 500 mg to about 550 mg, from about 550 mg to about 600 mg, from about 600 mg to about 650 mg, from about 650 mg to about 700 mg, from about 700 mg to about 750 mg, from about 750 mg to about 800 mg, from about 800 mg to about 850 mg, from about 850 mg to about 900 mg, from about 900 mg to about 950 mg, or from about 950 mg to about 1000 mg. In some cases, a dose of a composition provided herein is at least about or at most about: 10,000, 15,000, 20,000, 22,000, 24,000, 25,000, 30,000, 40,000, 50,000, 60,000, 70,000, 80,000, 90,000, 100,000, 125,000, 150,000, 200,000, or 500,000 units/kg body weight. In some embodiments, a therapeutically effective dose is at most about 10,000, 15,000, 20,000, 22,000, 24,000, 25,000, 30,000, 40,000, 50,000, 60,000, 70,000, 80,000, 90,000, 100,000, 125,000, 150,000, 200,000, or 500,000 units/kg body weight. Any one of the described dosages can be determined using the 95% CI for plasma volumes and body surface areas in males and females and an 10×IC50 (to achieve an about IC90 concentration, based on the shapes of a killing curves). In some cases, a dose range is from about 17-440 micromoles/m^2 (body surface area) per peptide. In some cases, a dosage is at least or at most about: 15, 25, 35, 45, 55, 65, 75, 85, 95, 105, 115, 125, 135, 145, 155, 165, 175, 185, 195, 205, 215, 225, 235, 245, 255, 265, 275, 285, 295, 305, 315, 325, 335, 345, 355, 365, 375, 385, 395, 405, 415, 425, 435, 445, 455, 465, 475, 485, 495, or up to about 500 micromoles/m^2 (body surface area) per peptide.

In some cases, unit dose forms can be packaged individually. Each unit dose can contain a predetermined quantity of an active ingredient(s) that can be sufficient to produce the desired therapeutic effect in association with pharmaceutical carriers, diluents, excipients, or any combination thereof. Examples of unit dose forms can include, ampules, syringes, and individually packaged tablets and capsules. In some instances, a unit dose form can be comprised in a disposable syringe. In some instances, unit-dosage forms can be administered in fractions or multiples thereof. A multiple-dose form can be a plurality of identical unit dose forms packaged in a single container, which can be administered in segregated a unit dose form. Examples of a multiple-dose form can include vials, bottles of tablets or capsules, or bottles of pints or gallons. In some instances, a multiple-dose form can comprise the same pharmaceutically active agents. In some instances, a multiple-dose form can comprise different pharmaceutically active agents.

In some embodiments, a pharmaceutical composition can comprise: a peptide or salt thereof; and at least one of: an excipient, a diluent, or a carrier.

Administration or application of a composition disclosed herein can be performed on any animal, such as a human, a non-human primate, a pet (e.g., a dog, a cat), or a farm animal (a horse, a cow, a goat, a pig). In some cases, administration or application of a composition disclosed herein can be performed on a human. In some cases, a human can be from about 1 day to about 1 month old, from about 1 month to about 12 months old, from about 1 year to about 7 years old, from about 5 years to about 25 years old, from about 20 years to about 50 years old, from about 45 years to about 80 years old, or from about 75 years to about 130 years old.

Compositions described herein can be administered before, during, or after the occurrence of a disease or condition, and the timing of administering a composition can vary. For example, a pharmaceutical compositions can be used as a prophylactic and can be administered continuously to subjects with a propensity to conditions or diseases in order to prevent the occurrence of the disease or condition. Pharmaceutical compositions can be administered to a subject during or as soon as possible after the onset of the symptoms. The administration of the molecules can be initiated within the first 48 hours of the onset of the symptoms, within the first 24 hours of the onset of the symptoms, within the first 6 hours of the onset of the symptoms, or within 3 hours of the onset of the symptoms. The initial administration can be via any route practical, such as by any route described herein using any formulation described herein, such as by oral administration, topical administration, intravenous administration, inhalation administration, injection, catheterization, gastrostomy tube administration, intraosseous administration, ocular administration, otic administration, transdermal administration, oral administration, rectal administration, nasal administration, intravaginal administration, intracavernous administration, transurethral administration, sublingual administration, or a combination thereof. A composition can be administered as soon as is practicable after the onset of a disease or condition is detected or suspected, and for a length of time necessary for the treatment of the disease, such as, for example, from about 1 month to about 3 months. The length of treatment can vary for each subject. In some cases, a method can further comprise administering a second therapy in a therapeutically effective amount. A second therapy can be administered concurrently or consecutively to provided compositions.

Administration or application of a composition disclosed herein can be performed for a duration of at least about at least about: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 150, 200, 300, 400, 500, 600, 700, 800, 900, 1000 days consecutive or nonconsecutive days. In some cases, the composition can be administered for life. In some embodiments, administration or application of the composition described herein can be from about 1 to about 30 days, from about 1 to about 60 days, from about 1 to about 90 days, from about 1 to about 300 days, from about 1 to about 3000 days, from about 30 days to about 90 days, from about 60 days to about 900 days, from about 30 days to about 900 days, or from about 90 days to about 1500 days. In some embodiments, administration or application of the composition described herein can be from: about 1 week to about 5 weeks, about 1 month to about 12 months, about 1 year to about 3 years, about 2 years to about 8 years, about 3 years to about 10 years, about 10 years to about 50 years, about 15 years to about 40 years, about 25 years to about 100 years, about 30 years to about 75 years, about 60 years to about 110 years, or about 50 years to about 130 years.

Administration or application of a composition disclosed herein can be performed for a duration of at least about 1 week, at least about 1 month, at least about 1 year, at least about 2 years, at least about 3 years, at least about 4 years, at least about 5 years, at least about 6 years, at least about 7 years, at least about 8 years, at least about 9 years, at least about 10 years, at least about 15 years, at least about 20 years, or for life. Administration can be performed repeatedly over a lifetime of a subject, such as once a day, once a week, or once a month for the lifetime of a subject. Administration can be performed repeatedly over a substantial portion of a subject's life, such as once a day, once a week, or once a month for at least about: 1 year, 5 years, 10 years, 15 years, 20 years, 25 years, 30 years, or more.

Administration or application of composition disclosed herein can be performed at least about: 1, 2, 3, 4, 5, 6, 7, 8, 9, 10, 11, 12, 13, 14, 15, 16, 17, 18, 19, 20, 21, 22, 23, or 24 times a in a 24-hour period. In some cases, administration or application of a composition disclosed herein can be performed continuously throughout a 24-hour period. In some embodiments, administration or application of composition disclosed herein can be performed at least about: 1, 2, 3, 4, 5, 6, 7, 8, 9, 10, 11, 12, 13, 14, 15, 16, 17, 18, 19, 20, or 21 times a week. In some cases, administration or application of a composition disclosed herein can be performed at least about: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, or more times a month. In some embodiments, a composition can be administered as a single dose or as divided doses. For example, administration of a capsule, or a tablet an comprise administration of more than one capsules or tablets. In some cases, the compositions described herein can be administered at a first time point and a second time point. In some embodiments, a composition can be administered such that a first administration can be administered before the other with a difference in administration time of about: 1 hour, 2 hours, 4 hours, 8 hours, 12 hours, 16 hours, 20 hours, 1 day, 2 days, 4 days, 7 days, 2 weeks, 4 weeks, 2 months, 3 months, 4 months, 5 months, 6 months, 7 months, 8 months, 9 months, 10 months, 11 months, 1 year or more.

Administration of a pharmaceutical composition described herein can be administered in one dose, continuously or intermittently throughout the course of treatment. Methods of determining the most effective means and dosage of administration can be determined by a physician or another medical professional and can vary with the composition used for therapy, the purpose of the therapy, and the subject being treated. For example, depending on the age and size of a subject, an appropriate dosage can be calculated. Additionally, an administration can be delivered locally or systemically depending on disease location. In some cases, compositions provided herein can be delivered via a vector or without a vector, for example as a naked composition. Single or multiple administrations can be carried out with the dose level and pattern being selected by the treating physician. Suitable dosage formulations and methods of administering the agents can be known in the art. Routes of administration can also be determined and method of determining the most effective routes of administration can be determined by a physician or another medial professional and can vary with the composition used for treatment, the purpose of the treatment, the health condition or disease stage of the subject being treated, and target cell or tissue. Non-limiting examples of routes of administration include oral administration, nasal administration, injection, and topical application.

Administration can refer to methods that can be used to enable the delivery of a pharmaceutical composition described herein (e.g. a peptide) to the desired site of biological action. For example, a nucleic acid encoding for a peptide described herein can be comprised in a viral vector and can be administered by intravenous administration. Administration disclosed herein to an area in need of treatment or therapy can be achieved by, for example, and not by way of limitation, oral administration, topical administration, intravenous administration, inhalation administration, or any combination thereof. In some embodiments, delivery can include injection, catheterization, gastrostomy tube administration, intraosseous administration, ocular administration, otic administration, transdermal administration, oral administration, rectal administration, nasal administration, intravaginal administration, intracavernous administration, transurethral administration, sublingual administration, or a combination thereof. Delivery can include direct application to the affected tissue or region of the body. In some cases, topical administration can comprise administering a lotion, a solution, an emulsion, a cream, a balm, an oil, a paste, a stick, an aerosol, a foam, a jelly, a foam, a mask, a pad, a powder, a solid, a tincture, a butter, a patch, a gel, a spray, a drip, a liquid formulation, an ointment to an external surface of a surface, such as a skin. Delivery can include a parenchymal injection, an intra-thecal injection, an intraventricular injection, or an intra-cisternal injection. A composition provided herein can be administered by any method. A method of administration can be by intraarterial injection, intracisternal injection, intramuscular injection, intraparenchymal injection, intraperitoneal injection, intraspinal injection, intrathecal injection, intravenous injection, intraventricular injection, stereotactic injection, subcutaneous injection, epidural, or any combination thereof. Delivery can include parenteral administration (including intravenous, subcutaneous, intrathecal, intraperitoneal, intramuscular, intravascular or infusion administration). In some cases, delivery can be from a device. In some instances, delivery can be administered by a pump, an infusion pump, or a combination thereof. In some embodiments, delivery can be by an enema, an eye drop, a nasal spray, or any combination thereof. In some instances, a subject can administer the composition in the absence of supervision. In some instances, a subject can administer the composition under the supervision of a medical professional (e.g., a physician, nurse, physician's assistant, orderly, hospice worker, etc.). In some embodiments, a medical professional can administer the composition.

In some cases, administering can be oral ingestion. In some cases, delivery can be a capsule or a tablet. Oral ingestion delivery can comprise a tea, an elixir, a food, a drink, a beverage, a syrup, a liquid, a gel, a capsule, a tablet, an oil, a tincture, or any combination thereof. In some embodiments, a food can be a medical food. In some instances, a capsule can comprise hydroxymethylcellulose. In some embodiments, a capsule can comprise a gelatin, hydroxypropylmethyl cellulose, pullulan, or any combination thereof. In some cases, capsules can comprise a coating, for example, an enteric coating. In some embodiments, a capsule can comprise a vegetarian product or a vegan product such as a hypromellose capsule. In some embodiments, delivery can comprise inhalation by an inhaler, a diffuser, a nebulizer, a vaporizer, or a combination thereof.

The following examples are intended to illustrate but not limit the disclosure. While they are typical of those that might be used, other procedures known to those skilled in the art may alternatively be used.

EXAMPLES

Design of Gene Fragment Libraries. Gene fragments from target genes were composed of the DNA coding sequence for all 40 mer amino acids from the genes listed in FIGS. 1B, 6 and 7. The 5' and 3' ends of each gene fragment were modified to contain a start and stop codon, as well as ~20 bp of DNA homologous to the expression plasmid for downstream Gibson cloning. For cell surface expression constructs start and stop codons were excluded.

Gene Fragment Cloning. Gene fragment libraries were synthesized as pooled single stranded oligonucleotides by Custom Array. These oligonucleotides were then PCR amplified using KAPA-HiFi (Kapa Biosystems) to generate double stranded gene fragments compatible with Gibson cloning. 50 μl PCR reactions were set up with 25 ng of pooled oligonucleotide template and 2.5 μl of primers PEP_1 and PEP_2 (10 μM). The thermal cycler was programmed to run at 95 C for 30 seconds, followed by 12 cycles of 98 C for 15 seconds, 65 C for 15 seconds, and 72 C for 45 seconds. This was followed by a final 5-minute extension at 72 C. PCR products were then purified using the QIAquick PCR purification kit. See Table 4 for primer sequences.

The gene fragment overexpression vector pEPIP was generated from a modified pEGIP (Addgene #26777). The vector was modified to remove the GFP insert, insert an EcoRI cloning site, and add primer binding regions with which to amplify the libraries for HTS. To clone the gene fragment libraries into the appropriate expression vector, pEPIP was first digested with EcoRI (NEB) for 3 hours at 37C. The linearized vectors were then column purified using the QIAquick PCR purification kit. Subsequently, Gibson assembly was used to clone the gene fragment libraries into the pEPIP vector. For each reaction, 10 μl of Gibson Reaction MasterMix (NEB) was combined with 100 ng of the vector and 50 ng of the double stranded gene fragment library, with H20 up to 20 μl. The Gibson reactions were then incubated at 50C for 1 hr and transformed via electroporation into 200 μl of ElectroMAX Stb14 competent cells (Invitrogen) according to the manufacturer's protocol. The Stb14 cells were then resuspended in 4 mL of SOC media and placed at 37C with shaking for 1 hr to recover. After recovering, 1 μl of the SOC/cell suspension was spread on LB-carbenicillin plates to calculate library coverage, with the remaining SOC/cells used to inoculate a 100 ml culture of LB-carbenicillin. Greater than 2000 fold library coverage was obtained to ensure all gene fragments were well represented. After 16 hours of incubation at 37C with shaking, plasmid DNA was isolated via a Qiagen Plasmid Plus Maxi Kit.

TABLE 4

Primers:

| Name | Description | Sequence |
|---|---|---|
| PEP_01 | Used to amplify initial oligo pool and individually synthesized cancer driver gene fragments for cloning | GGCTAGGTAAGCTTGATATCG GCCACCATG (SEQ ID NO: 9512) |
| PEP_02 | Used to amplify initial oligo pool and individually synthesized cancer driver gene fragments for cloning | GGCGGCACTGTTTAACAAGCC CGTCAGTAG (SEQ ID NO: 9513) |
| PEP_03 | Used to amplify cancer driver gene fragments for high throughput sequencing | ACACTCTTTCCCTACACGACG CTCTTCCGATCTGCTTGATAT CGGCCACCATG (SEQ ID NO: 9514) |
| PEP_04 | Used to amplify cancer driver gene fragments for high throughput sequencing | GACTGGAGTTCAGACGTGTGC TCTTCCGATCTCACTGTTTAA CAAGCCCGTCAGTAG (SEQ ID NO: 9515) |
| PEP_05 | Used to amplify Betacoronavirus receptor oligo pools and individually synthesized gene fragments for cloning | TGACGGTTCTGGGAGCGGTTC T(SEQ ID NO: 9516) |
| PEP_06 | Used to amplify Betacoronavirus receptor oligo pools and individually synthesized gene fragments for cloning | GTTCGCTGCCGGACCCACTTC C (SEQ ID NO: 9517) |
| PEP_07 | Used to amplify Betacoronavirus receptor gene fragments for high throughput sequencing | ACACTCTTTCCCTACACGACG CTCTTCCGATCTTGACGGTTC TGGGAGCGGTTCT (SEQ ID NO: 9518) |

TABLE 4-continued

| Primers: | | |
|---|---|---|
| Name | Description | Sequence |
| PEP_08 | Used to amplify Betacoronavirus receptor gene fragments for high throughput sequencing | GACTGGAGTTCAGACGTGTGC TCTTCCGATCTGTTCGCTGCC GGACCCACTTCC (SEQ ID NO: 9519) |
| EF1a_seq | Used for Sanger sequencing of constructs cloned into peptide expression vectors | TTCTCAAGCCTCAGACAGTGG (SEQ ID NO: 9520) |

Lentivirus Production. Replication deficient lentiviral particles were produced in HEK293FT cells (Invitrogen) via transient transfection. HEK293FT cells were grown in DMEM media (Gibco) supplemented with 10% FBS (Gibco). The day before transfection, HEK293FT cells were seeded in a 15 cm dish at ~40% confluency. The day of transfection, the culture media was changed to fresh DMEM plus 10% FBS. At the same time, 3 ml of Optimem reduced serum media (Life Technologies) was mixed with 36 μl of lipofectamine 2000, 3 μg of pMD2. G plasmid (Addgene #12259), 12 μg of pCMV deltaR8.2 plasmid (Addgene #12263), and 9 μg of the gene fragment plasmid library. After 30 minutes of incubation, the plasmid/lipofectamine mixture was added dropwise to theHEK293FT cells. Supernatant containing viral particles was harvested 48 and 72 hours after transfection and concentrated to 1 ml using Amicon Ultra-15 centrifugal filters with a cutoff 100,000 NMWL (Millipore). The viral particles were then aliquoted and frozen at −80C until further use.

Fitness Screening in Mammalian Cell Lines. Hs578T cells and MDA-MB-231 cells were cultured in DMEM media supplemented with 10% FBS. Cells were transduced with the gene fragment library at an MOI<0.3 to ensure each cell received a single construct. Viral transduction was performed in media containing 8 μg/ml polybrene to improve transduction efficiency. For each cell line, screening was conducted with two biological replicates. 48 hours after transduction, the cell culture media was changed to DMEM containing puromycin to select for transduced cells. 2 μg/ml puromycin was used to select the Hs578T cells, and 3.5 μg/ml puromycin was used to select the MDA-MB-231 cells. For both cell lines, more than 6,000,000 cells were transduced to ensure greater than 1000-fold coverage of the library. The cells were cultured for 14 days after transduction, with genomic DNA isolated via a Qiagen DNeasy Blood and Tissue Kit at days 3 and 14.

HTS Library Preparation and Sequencing. Gene fragments for each time point and replicate were then amplified from the genomic DNA using Kapa HiFi. The fragments serve as their own barcodes for downstream abundance calculations. Illumina compatible libraries were prepared using 2.5 μl of primers PEP_3 and PEP_4 (10 μM) per 50 μl reaction. For each sample 10 separate 50 μl PCR reactions with 4 μg of gDNA each (40 μg total) were performed to ensure adequate library coverage. Thermal cycling parameters were identical to those used to amplify the gene fragment oligos, with the exception that the gDNA required 26 cycles to amplify. NEBNext Multiplexed Oligos for Illumina (NEB) were used to index the samples, and 150 bp single end reads were then generated via an Illumina HiSeq2500. Greater than 500-fold sequencing depth was used to ensure accurate abundance quantitation. For the larger libraries, the number of PCR reactions was scaled to process 300 μg of total gDNA per timepoint and replicate. The larger libraries were then sequenced with 100 bp paired end reads generated via an Illumina HiSeq4000.

Processing of sequencing files. To quantify gene fragment relative abundance, the library definition text file (containing gene fragment names and sequences) was first converted into Fasta format. This Fasta file was then used to build a Bowtie2 index file. Raw FASTQ reads were then mapped to the library index file via Bowtie2. For the expanded libraries paired end reads were first merged into a single FASTQ file via FLASH (Fast Length Adjustment of SHort reads). Reads with insertion or deletion mutations were removed to eliminate spurious data resulting from out of frame gene fragments. The resulting SAM files were then compressed to BAM files via SAMtools. Following this, the count module in MAGeCK was used to determine the gene fragment abundances from the alignment files and indivisual peptide log fold change and depletion P-values.

Calculation of Amino Acid Level Depletion Scores. After generating the gene fragment count files, all downstream analysis was performed in R. For each amino acid residue in the overall protein structure, an amino acid level log fold change was calculated by taking the mean log 2 fold change of all overlapping gene fragments for each replicate. The geometric mean of the biological replicates was then used for downstream analysis. For every residue in the protein scaffolds, this mean log 2 fold change (x) was then converted to a z-score (z), normalizing to the library wide amino acid log 2 fold change standard deviation (δ) and mean (μ)

$$\text{Fitness Score} = Z = \frac{x - \mu}{\sigma}$$

To identify amino acid positions which were significantly depleted, a one tailed permutation test was performed. The approximate permutation distribution of amino acid fitness scores was generated by randomly shuffling the labels of all gene fragments in the screen. This shuffled data was subsequently used to recalculate the amino acid fitness scores. This resampling procedure was then repeated N=10,000 times, with the P values for each amino acid position calculated by the following:

$$P = \frac{\sum_{i=1}^{N} (Fitness_{Perm} < Fitness_{Obs})}{N \text{ permutations}}$$

These P values were then adjusted for multiple comparison testing by the Benjamini-Hochberg procedure. The R packages “ggplot2”, “dplyr”, and “zoo” were used to generate figures. An analogous procedure was used to identify enriched domains (and corresponding enrichment scores) when screening coronavirus receptor peptides for binding to the spike protein/RBD.

Validating Highly Depleted Gene Fragments. All cell lines used were cultured in DMEM media supplemented with 10% FBS. The fitness impact of highly depleted gene fragments was tested in an arrayed format via a WST-8 (Dojindo) cell growth assay. Highly depleted gene fragments were synthesized by Twist Biosciences, cloned directly into the pEPIP vector, and subsequently packaged into lentiviral particles. Cells were transduced at an MOI of 4 and switched to puromycin containing media after 48 hours. Following 24 hours of puromycin selection 1,500 cells were seeded per well as biological replicates in a 96 well plate. All experimental groups for Hs578T cells had n=4. For MDA-MB-231 cells, all experimental groups had n=4, with the exception of the GFP control which had n=8. For HEK293T and MCF-7 cells all experimental groups had n=8. 2 μg/ml puromycin was used to select Hs578T and MCF-7 cells, while 3.5 μg/ml puromycin was used to select MDA-MB-231 and HEK293T cells. For the second panel of experiments (DICER1-552, etc.) all experimental groups had n=6. Cell growth was then quantified via absorbance at 450 nm following 1.5 hrs of incubation with WST-8 reagent. A two-tailed P value was then calculated via an unpaired ttest with Welch's correction.

Engineering Peptides for Exogenous Delivery. Peptides shown in FIG. 3B were fused to an N-terminal cell penetrating motif via a (GS)3 linker sequence (Table 5) and chemically synthesized by GenScript's Custom Peptide Synthesis service at crude purity. For dose response experiments, cells were plated in 96 well plates (n=4) at 50% confluency and peptides were added at the indicated concentrations with cell viability quantified after 24 hrs via the WST-8 assay. Cell viability was normalized to that of an untreated control on the same plate.

TABLE 5

| Name | Amino Acid Sequence |
|---|---|
| TAT-EGFR-697 | GRKKRRQRRRPPQGSGSGSMEA PNQALLRILKETEFKKIKVLGS GAFGTVYKGLWIPEGE (SEQ ID NO: 9521) |
| TAT-RAF1-73 | GRKKRRQRRRPPQGSGSGSMRN GMSLHDCLMKALKVRGLQPECC AVFRLLHEHKGKKARL (SEQ ID NO: 9522) |
| TAT-RAF1-78 | GRKKRRQRRRPPQGSGSGSMLH DCLMKALKVRGLQPECCAVFRL LHEHKGKKARLDWNTD (SEQ ID NO: 9701) |
| TAT-FLAG | GRKKRRQRRRPPQGSGSGSDYK DHDGDYKDHDIDYKDDDDK (SEQ ID NO: 9522) |

Co-Immunoprecipitation. HEK293T cells were seeded in 6 well plates to be 75% confluent on the day of transfection. Transfections were performed with 1 μg of each indicated plasmid per well with 5 μl of Lipofectamine 2000 according to the manufacturers protocol. 48 hours after transfection, cells were washed twice with ice cold PBS and lysed for 30 minutes in ice cold 400 μl TBS buffer containing 0.5% Triton x-100, 1 mM EDTA, and Halt Protease Inhibitor Cocktail (Thermo Fisher 78429). The supernatant was then clarified by centrifugation at 14,000 G for 15 minutes. Following this, immunoprecipitation of FLAG tagged constructs was performed by adding 300 μl of the lysate to 20 μl of packed anti FLAG agarose beads (Millipore Sigma A2220) prewashed with TBS. The remaining 100 μl of lysate was stored at −80C for later analysis. The bead-lysate mixture was then mixed end over end at 4C for 2 hours. After binding to the beads, the bead-protein complexes were washed three times with 1 ml lysis buffer and eluted with 20 μl of 2×SDS-PAGE Laemmli loading buffer (BioRad 1610737).

Western Blotting. Proteins were first separated on 4-20% polyacrylamide gels (BioRad 4561094) under denaturing conditions in Tris-Glycine-SDS (BioRad 1610732) for 1 hour at 100V. Following this, proteins were transferred to 0.2 μm nitrocellulose membranes (BioRad 1620112) for 30 minutes at 100V in Tris-Glycine buffer (BioRad 1610734) containing 30% methanol. Membranes were then blocked for 1 hour in TBS-T (Cell Signaling 9997) containing 5% non-fat dry milk (BioRad 1706404XTU). Primary antibodies were then added (diluted 1:1000 in TBS-T+ 5% milk) and incubated overnight at 4C with gentle agitation. The following day the membranes were washed three times in TBS-T and incubated for 1 hour with HRP conjugated secondary antibodies (diluted 1:10,000 in TBS-T) at room temp. The membranes were then washed again three times with TBS-T and developed using SuperSignal West Pico Plus Chemiluminescent Substrate (Thermo Fisher 34577).

Immunofluorescence. Cells were plated the day before transduction at approximately 20% confluency. On the day of transduction, cells were transduced with the appropriate lentiviral constructs at an MOI of 1 and allowed to grow for 72 hours. Following this, the cells were washed twice with PBS and fixed for 30 minutes at room temperature with 4% paraformaldehyde. Cells were then washed three times with PBS and blocked for 1 hour at room temp with TBS plus 5% Sea Block (Thermo Fisher PI37527X3) and 0.2% Triton x-100. The blocking buffer was then aspirated and replaced with blocking buffer plus anti-FLAG primary antibody at a 1:500 dilution. The primary antibody was then allowed to bind overnight at 4C. The following day, the cells were washed three times with PBS, and incubated for 1 hour with a secondary anti-mouse IgG antibody conjugated to DyLight 488 (diluted 1:200). The cells were then washed three times with PBS and subsequently imaged via fluorescence microscopy.

RNA-Seq of Highly Depleted Fragments. RNA sequencing was performed on Hs578T cells 6 days after transduction with lentivirus expressing gene fragments of interest. Two biological replicates were sequenced for each experimental condition. Total RNA was isolated from cells via an RNEasy Kit (Qiagen) with on column DNAse I treatment. An NEBNext Poly(A) mRNA Magnetic Isolation Module (E7490S) was then used to deplete rRNA. Subsequently, an NEBNext Ultra RNA Library Prep Kit (E7530S) was used to generate Illumina compatible RNA sequencing libraries. Sequencing was performed on an Illumina HiSeq4000, with paired end 100 bp reads. Reads were aligned to the human reference transcriptome via the STAR aligner, and differential gene expression was performed using DESeq2. Differential expression was tested in reference to a control group transduced with lentivirus coding for GFP. Following this, the R package "fgsea" was used to conduct GSEA pre-ranked analysis. Genes were ranked via the shrunken log fold change values outputted by DESeq2.

Network Visualization. Network of protein-protein interactions was generated using publicly available data from STRING. Edges were drawn for all interactions with a confidence score greater than 0.98, taking into account all interaction sources available. Node color was based on fitness scores for each gene available via DepMap CRISPR knockout screening. The CERES normalized gene effects were used to quantify the fitness impact of a given knockout. Visualization was then performed in CytoScape.

Self-Surface Peptide Cloning. The cell surface peptide expression vector (pEsPIP) was generated from a modified pEGIP (Addgene #26777). The vector was modified to remove the GFP insert, and insert a cloning site flanked by an in-frame Ig Kappa leader sequence and PDGFR transmembrane domain to ensure proper localization of peptides. Cell surface peptide libraries were amplified with PEP_5 and PEP_6 and cloned via Gibson Assembly into pEsPIP as described above.

Screening for Betacoronavirus Binders using Magnetic Cell Isolation. Preparation of lentivirus and transduction of NIH-3T3 cells was performed as above, with care taken to ensure 1,000 fold library coverage during transduction. 48 hours after transduction, cells were selected with 3 μg/ml of puromycin. 72 hours after transduction, cells were incubated for 30 minutes on ice with 25 μg/mL of the appropriate mouse Fc tagged Betacoronavirus protein (Sino Biological 40592-V05H and 40591-V05H1) and subsequently washed once with PBS to remove free protein. Cells were then incubated with anti-mouse Fc magnetic beads for 15 minutes (Miltenyi 130-048-401), washed again with PBS and subjected to magnetic activated cell sorting according to the manufacturers protocol. The bound fraction was subsequently washed thrice and then eluted. Genomic DNA was then extracted and sequencing libraries generated as above (using primers PEP_7/8).

Recombinant Peptide Production. Recombinant production protocol was adapted from (Tropea et al., 2009). Recombinant MBP fusions and TEV protease were cloned into the pET Champion vector (Thermo K630203) and expressed in T7 express *E. coli* (NEB C2566I). Constructs were ordered as gBlocks from IDT and cloned directly into the vector via Gibson Assembly. To produce high yield MBP-peptide fusions and TEV protease, a 10 mL starter culture of *E. coli* was grown for 14 hours at 37C in TB media. This starter culture was then used to induce a 1L culture of TB media. This culture was grown at 37C until an OD of 0.8, and then induced with 0.5 mM IPTG. The cells were subsequently grown overnight at 25C, following which the cells were pelleted and stored at −20C. To isolate recombinant proteins, cells were first lysed via mechanical disruption with mortar and pestle in liquid nitrogen and resuspended in binding buffer (50 mL 50 mM sodium phosphate, 200 mM NaCl, 10% glycerol, and 25 mM imidazole at pH 8.0). Cell lysate was then clarified via centrifugation for 30 minutes at 20,000 g. Following this, the soluble fraction of the lysate was applied via gravity flow to 5 mL of a pre-equilibrated Ni-NTA resin (Thermo 88221). The resin was subsequently washed with 15 column volumes of binding buffer, and eluted with 50 mM sodium phosphate, 200 mM NaCl, 10% glycerol and 250 mM imidazole at pH 8.0. Purified TEV protease and the MBP-peptide fusions were subsequently dialyzed into cleavage buffer (50 mM sodium phosphate, 200 mM NaCl, pH 7.4) using Amicon 3 kD MWCO centrifugal spin filters (Millipore UFC800324). Cleavage reactions were set up in cleavage buffer containing 2 mg/mL MBP-peptide fusion, 0.2 mg/mL TEV protease, and 1 mM DTT (added fresh). This reaction was allowed to proceed overnight at 25C. The following day, the cleavage reaction was diluted 1:8 with binding buffer and applied over a pre-equilibrated Ni-NTA resin to remove the TEV protease and MBP proteins (1 mL resin per 5 mg fusion protein). The flow through (containing purified peptide) was subsequently dialyzed into PBS and concentrated to 5 mg/mL.

Engineering Peptides for Exogenous Delivery. Peptides shown in FIG. 2D were fused to an N-terminal cell penetrating motif via a (GS)3 linker sequence and chemically synthesized by GenScript's Custom Peptide Synthesis service at crude purity. For dose response experiments, cells were plated in 96 well plates (n=4) at 50% confluency and peptides were added at the indicated concentrations with cell viability quantified after 24 hrs via the WST-8 assay. Cell viability was normalized to that of an untreated control on the same plate.

Figure 1B:
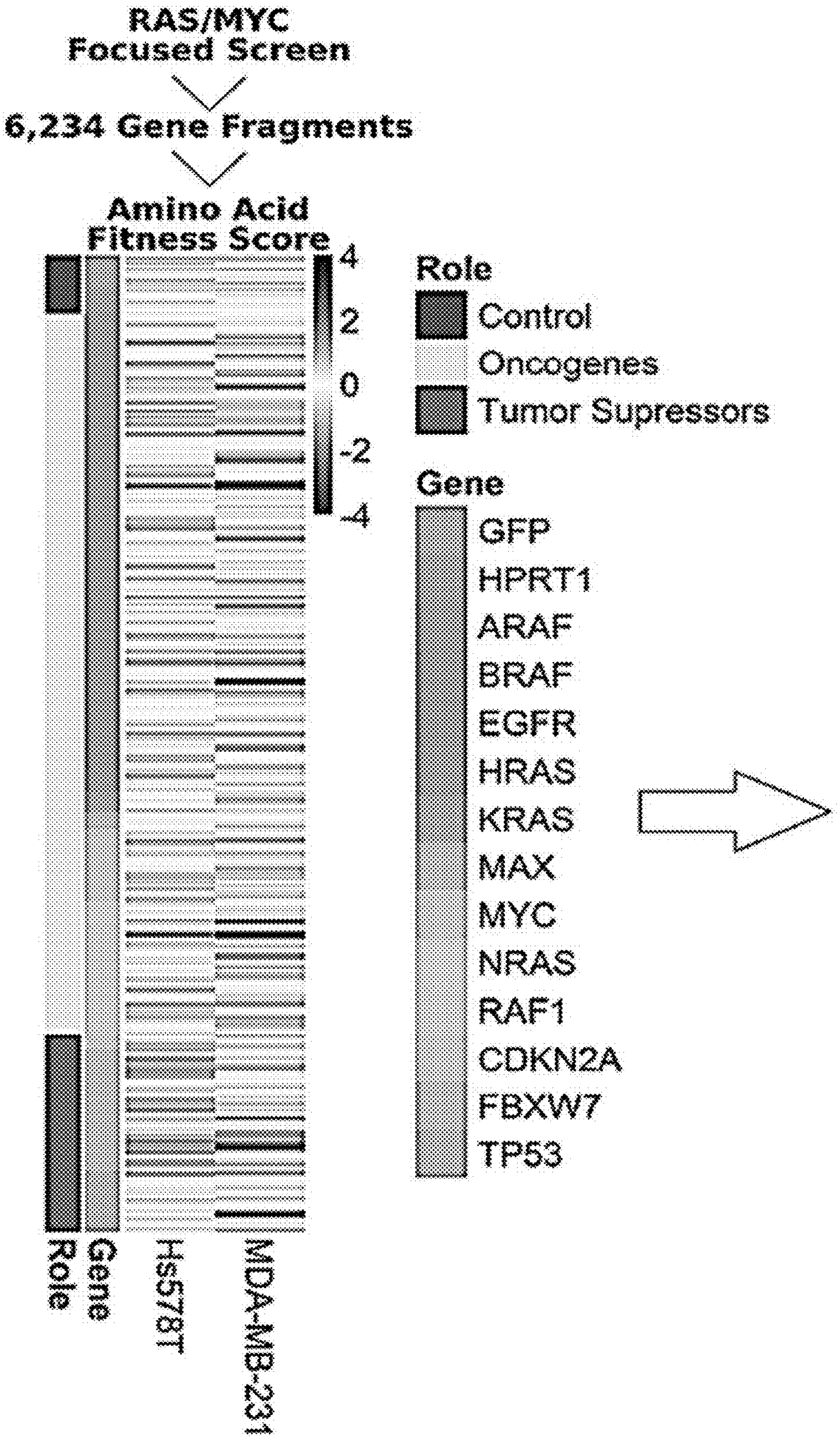
Figure 1B:
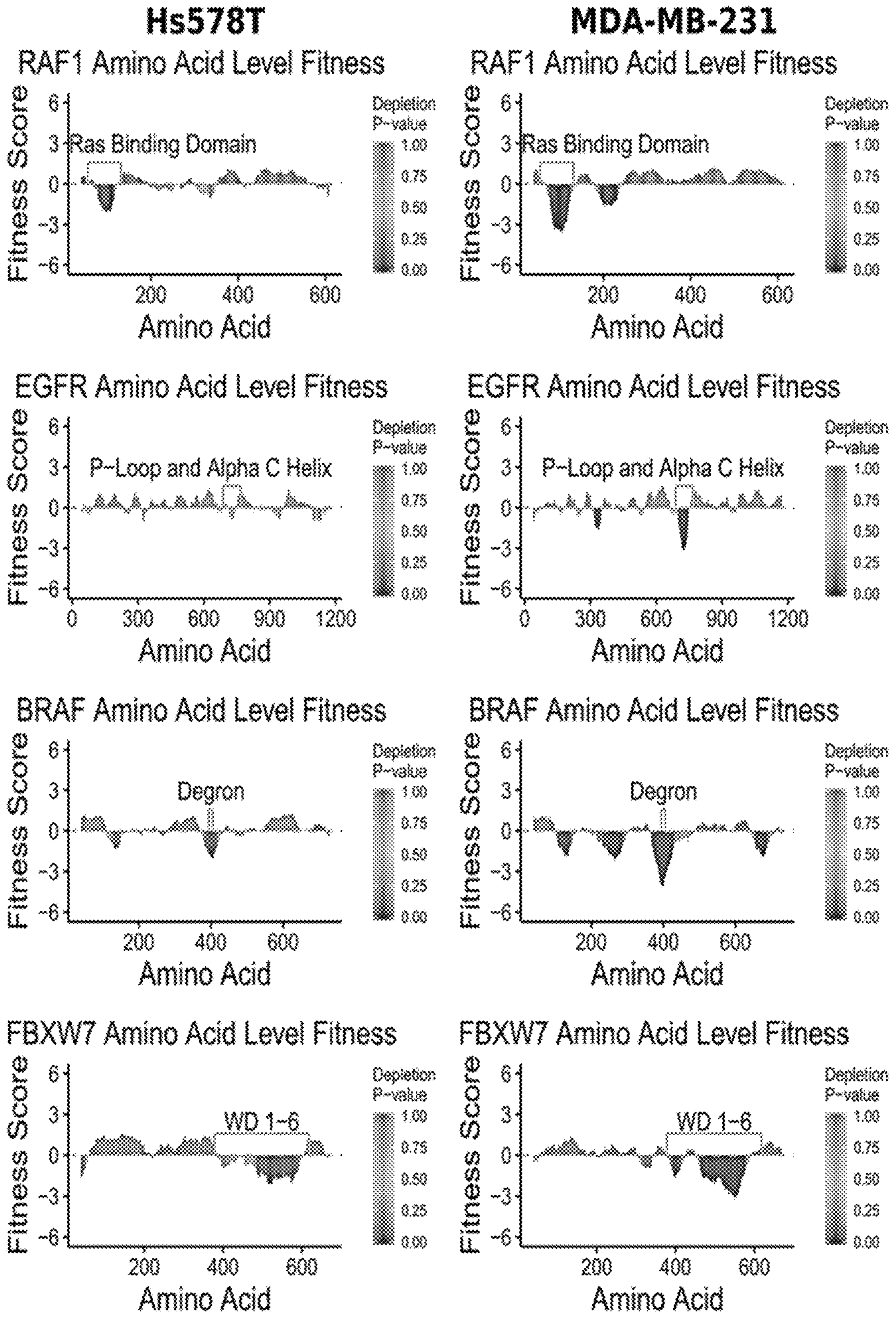

Using the screening methods described herein a pilot peptide library was generated. Lentiviral libraries of synthetic gene fragments comprehensively tiling intracellular (cancer driver genes) and extracellular (receptors of Betacoronaviruses) proteins that serve as drivers of pathological processes was developed. Towards the former, a pilot peptide library of oncogenes and associated effectors from the RAS and MYC signaling pathways were synthesized (FIG. 1A-B). RAS and MYC are two of the most frequently mutated/amplified oncogenes across a wide variety of malignancies, highlighting the medical need to identify functional inhibitors. Compounding this, RAS and MYC have proven challenging to drug via small molecules, due to their lack of a binding pocket and reliance on PPIs for signal transduction. Owing to their larger size and ability to form complex folded structures, it was surmised peptide biologics are likely suited to disrupting the protein-protein interactions through which RAS and MYC mediate cellular proliferation.

Figure 3A:
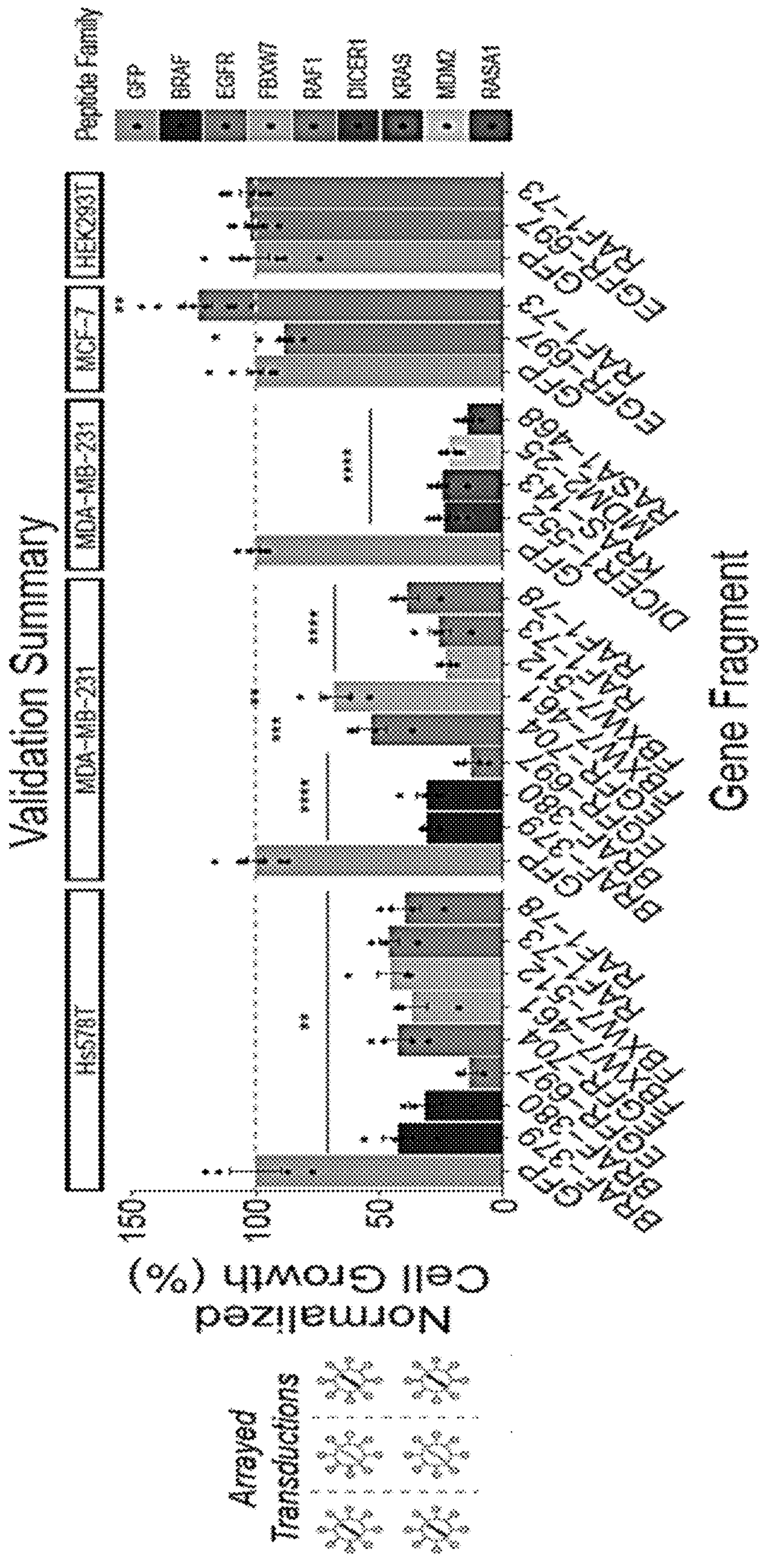
FIG. 3A-D shows validation of anti-proliferative peptides confirms target specific functionality: (A) In vitro arrayed validation of lentivirus delivered gene fragments derived from WT proteins. Peptides predicted to be deleterious to cell growth (by depletion in pooled screen) significantly inhibited proliferation relative to GFP control. Cell proliferation was measured via the WST-8 assay after one week of growth following lentiviral transduction. Bar plots indicate mean, with error bars representing standard error (*P<0.05, P<0.01,*P<0.001,****P<0.0001). Each panel represents a separately conducted experiment (hence the two MDA-MB-231 panels). (B) Validation with chemically synthesized peptides (n=4). Chemically synthesized EGFR-697 and RAF1-73 conjugated to a cell penetrating TAT protein transduction motif were added to cells at 0-100 μM. A 3×FLAG Peptide conjugated to TAT served as the negative control. Cell viability was measured 24 hours later by the WST-8 assay, indicating EGFR-697 and RAF1-73 function effectively in vitro to inhibit the growth of Hs578T and MDA-MB-231 cells in a dose dependent manner. Dotted lines indicate 95% confidence intervals for nonlinear fit. (C) Peptide mechanism explored via co-immunoprecipitation. 3×-Flag tagged RAF1-73 derived from the Ras binding domain of RAF1 pulls down activated Ras when immunoprecipitated, indicating retention of WT domain biological functionality. (D) Results of RNA-sequencing on EGFR-697 expressing Hs578T cells. EGFR-697 overexpression results in significant growth arrest, and differential expression of 225 genes, as well as significant downregulation of pathways relevant to cellular proliferation. Additional GSEA analysis revealed a transcriptional phenotype consistent with EGFR inhibition. Gene set "KOBAYASHI_EGFR_SIGNALING_24 HRS_DN" is a gene set composed of genes downregulated upon treatment with an irreversible EGFR inhibitor in H1975 cells. Treatment with EGFR-697 peptide results in significant downregulation of this gene set in Hs578T cells. The "KOBAYASHI_EGFR_SIGNALING_24 HRS_UP" is a gene set from the same experiment highlighting genes which are upregulated upon EGFR inhibition. This gene set is significantly upregulated upon EGFR-697 overexpression.

For every target protein in the library, gene fragments were synthesized via oligonucleotide pools coding for every possible overlapping 40 mer peptide within the proteins primary structure. Testing every overlapping 40 mer improves statistical power and allows for sensitive discrimination of similar peptide motifs, minimizing the required downstream optimization of inhibitors. To maximize the chance of identifying a peptide inhibitor of RAS or MYC signaling, gene fragments derived from the downstream RAS effectors ARAF, BRAF, and RAF1, were included as well as the negative regulator of MYC stability FBXW7. FBXW7 was of interest due to its role in regulating the degradation of several other key oncogenes. In addition to gene fragments derived from the wild-type RAS and MYC proteins, fragments derived from pathogenic Ras variants that have been shown to have unique protein-protein interaction networks were also included. Furthermore, gene fragments derived from EGFR (due to its role in oncogenic signal transduction to Ras proteins), from the HRAS S17N dominant negative, and the MYC dominant negative Omomyc were also included. As negative controls fragments derived from the green fluorescent protein (GFP) and hypoxanthine (-guanine) phosphoribosyltransferase (HPRT1) were used. Finally, two canonical tumor suppressor genes TP53 and CDKN2A were used. After removing duplicates, the final library consisted of 6234 unique gene fragments, spanning 14 full length genes. The pooled library of gene fragments was then synthesized as single stranded oligonucleotides and cloned into a lentiviral vector, with an EF1a promoter driving gene fragment transcription (FIG. 1A, 3A). An internal ribosomal entry site (IRES) was placed after the gene fragment stop codon to allow for co-translation of a puromycin acetyltransferase gene. This allowed for selection of transduced cells via the addition of puromycin to the cell culture media.

Figure 3B:
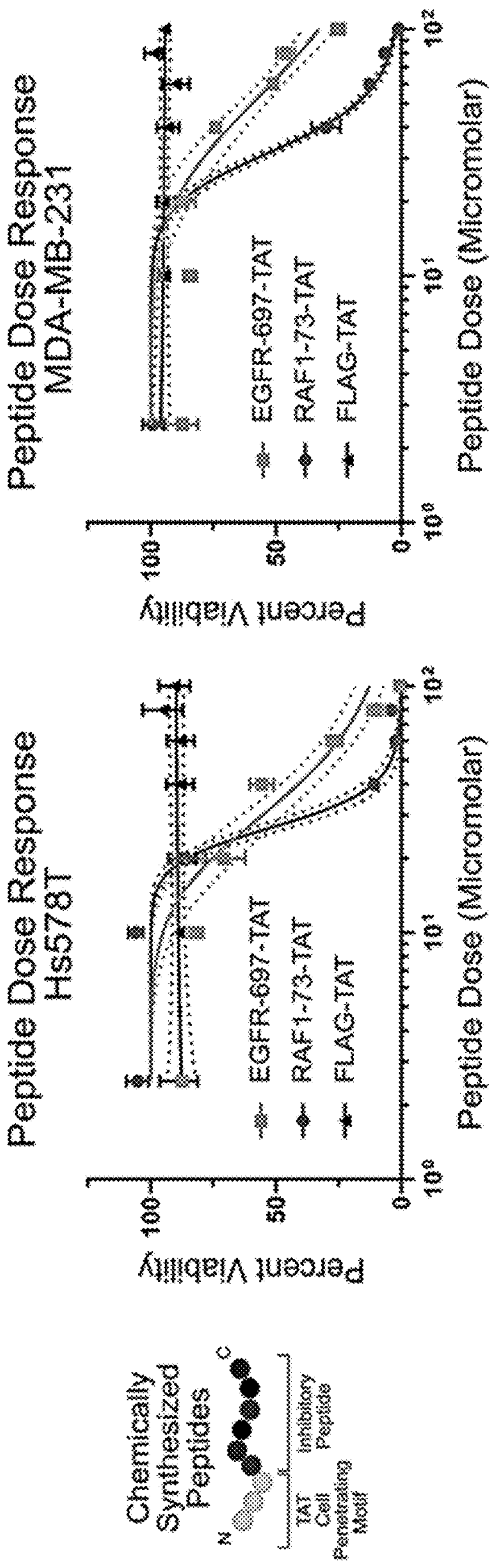

The library was then packaged into lentiviral particles which were used to transduce Hs578T and MDA-MB-231 cells in duplicate (FIG. 1A). Genomic DNA was isolated three days after transduction, as well as 14 days after transduction to calculate fragment specific log 2 fold changes. These gene fragment specific log 2 fold change values were then used to calculate an amino acid level fitness score via the mean of all fragments which overlap a particular codon (FIG. 1A-B, 3B). This score serves as a metric with which to reduce noise between closely related peptides, as well as a way to map the results back to the original protein structure. Based on this, 2.9% (Hs578T) and 10.5% (MDA-MB-231) of residues tested had significantly depleted overlapping peptides, indicating peptides derived from these positions were collectively more deleterious to cell fitness than a random sampling of peptides from the library (FIG. 3B). There was good correlation between biological replicates, with the Hs578T and MDA-MB-231 amino acid scores having a Pearson correlation of 0.54 and 0.75, respectively.

In order to visualize protein motifs with a significant impact of cell fitness, the amino acid scores were superimposed along the primary amino acid sequence for each associated protein (FIG. 1B). EGFR, BRAF, FBXW7 and RAF1 all had significant regions of significant depletion in one of the cell lines tested, corresponding to previously annotated protein function. Peptides derived from the P-loop and Alpha C-Helix of EGFR were depleted across both cell lines, likely due to the role of the P-loop in ATP binding, as well as the conformationally sensitive role the auto-inhibitory C-Helix plays in regulating EGFR enzymatic activity. Supporting a functional role for this depleted EGFR domain, this region of the EGFR gene (Exon 19) is frequently deleted in cancer, comprising approximately 44% of activating EGFR mutations seen clinically. The Ras Binding Domain (RBD) of RAF1 was also significantly depleted across both cell lines, presumably due to the blocking of Ras-Raf interactions by titrating out the binding site on endogenous RAF1 proteins. FBXW7 had a broad region of depletion corresponding to WD repeats 1-6. Knock-out screening via CRISPR-Cas9 has shown FBXW7 is not essential in Hs578T or MDA-MB-231 cells, meaning it is unlikely that this depletion is due to direct inhibition of FBXW731. The WD repeats in FBXW7 mediate substrate binding and subsequent recruitment to the E3 ubiquitin-protein ligase complex, suggesting the highly depleted peptides may retain the ability of the full length protein to bind oncogenes such as MYC38. BRAF had several significantly depleted regions dispersed across the primary sequence including one corresponding to a previously identified phospho-degron motif centered on amino acids 394-405.

Figure 1C:
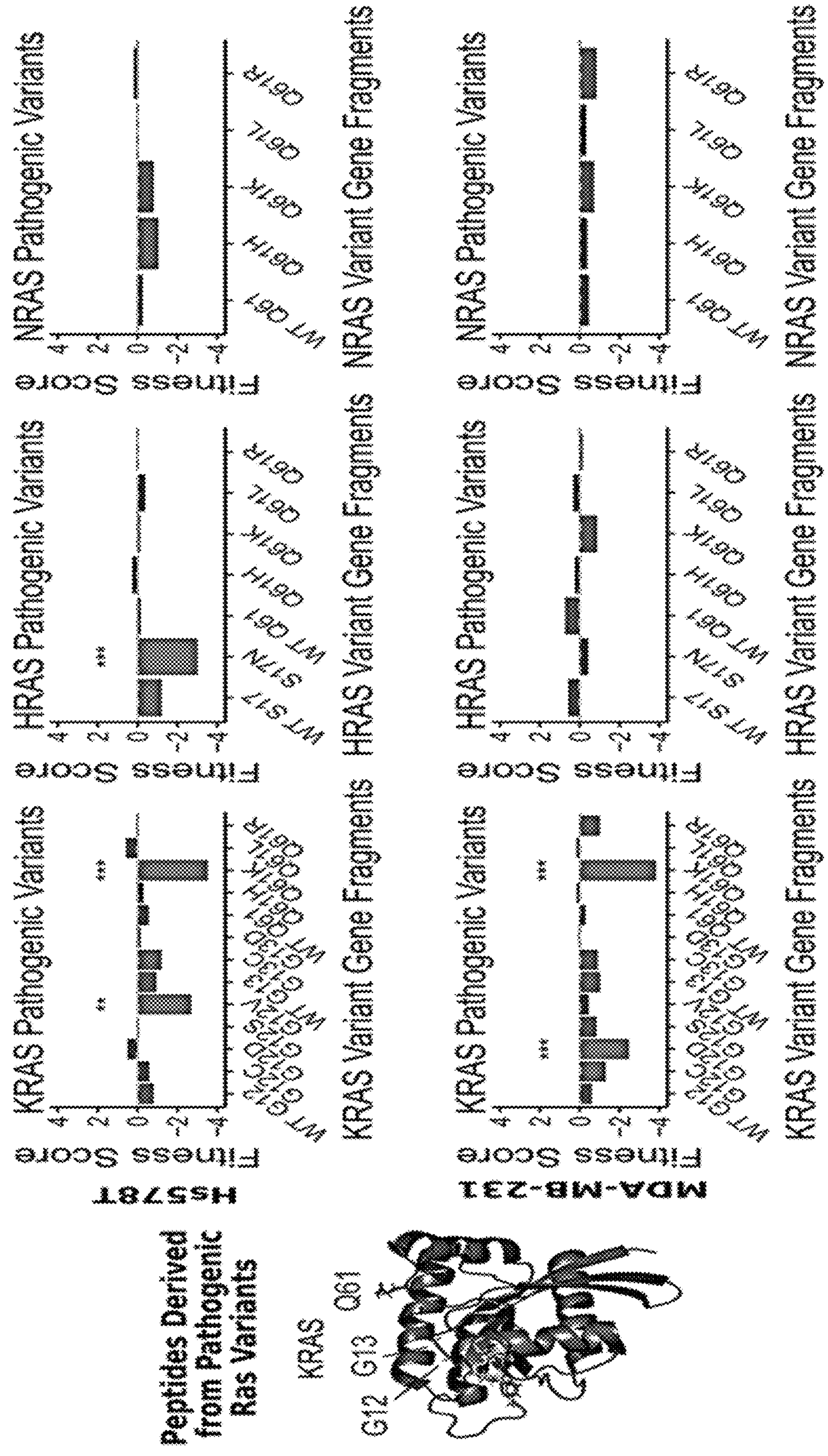

Towards the broader goal of identifying highly specific inhibitors of KRAS function, peptides derived from pathogenic variants were tested to see if they could function as more effective dominant negative proteins (FIG. 1C). Interestingly, the 40 mer peptides derived from KRAS Q61K (see, e.g., SEQ ID NO:9602 and fragments SEQ ID NOs: 4161-4168 as well as SEQ ID NOs:962-1052, 2704-2721, 3186-3198, 6708-6805) were significantly depleted across both cell lines, while wild type peptides overlapping amino acid showed no effect on cell fitness. The full length Q61K mutant is highly transforming due to a modified Ras/Raf interaction. This may play a role in the anti-proliferative activity of the Q61K derived fragments (e.g., SEQ ID NOs:4161-4168). Furthermore, peptides derived from the known HRAS S17N dominant negative mutant showed selective depletion only in the mutant HRAS driven Hs578T cell line, highlighting the ability of this technology to discriminate fitness dependencies with high specificity.

Figure 2A:
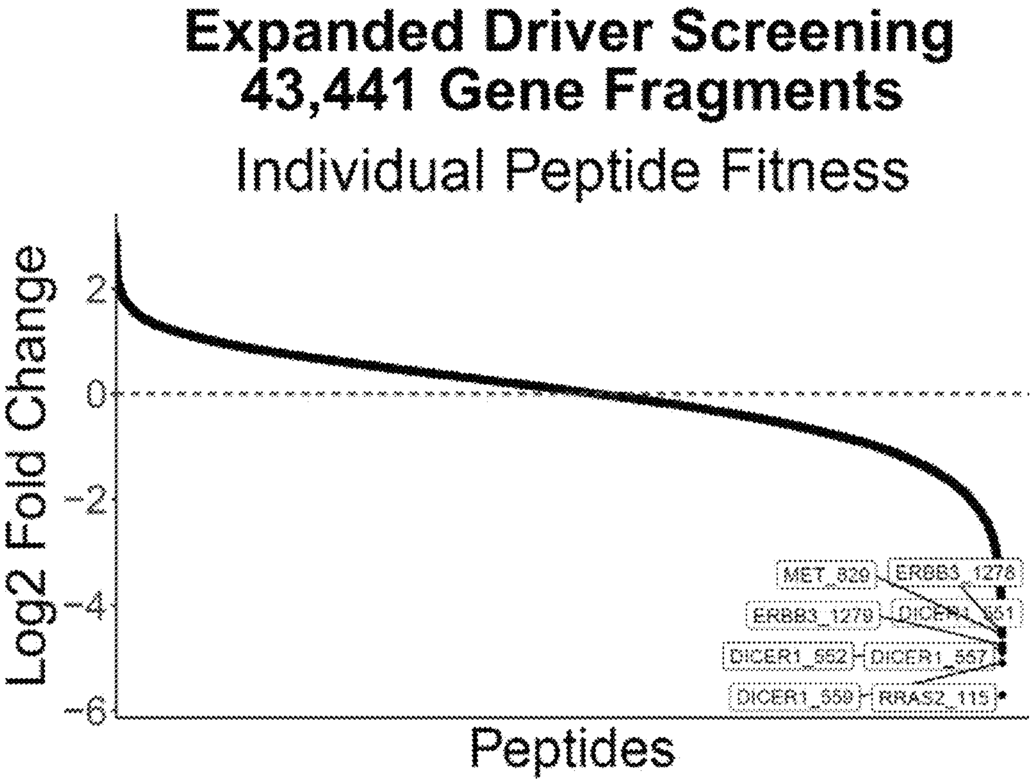
FIG. 2A-F shows gene fragment screening identifies motifs which function as inhibitors of cancer cell proliferation: (A) Plot of individual peptide enrichment/depletion for expanded screen. Peptides are centered around zero depletion, with a subpopulation being significantly deleterious to cells when overexpressed genetically. Peptides with $\log_2$ fold change values less than −4.5 are labeled. Cancer driver genes were hand curated, with additional controls added from the pilot screen. (B) Plot of individual peptide enrichment/depletion for mutant screen. 579 mutant cancer drivers covering 53 driver genes were assayed for growth inhibition as in (A). Peptides are centered around zero depletion, with a subpopulation being significantly deleterious to cells when overexpressed genetically. Peptides with $\log_2$ fold change values less than −7 are labeled. (C) Per position fitness scores for NFE2L2, MDM2, and PIK3CA. Select known PPIs are annotated on the plots, corresponding to regions of significant depletion. (D) Network of potential interactions among cancer drivers in this gene set. Interaction data is sourced from STRING, with fitness data from DepMap CRISPR screening overlaid. Nodes colored in light gray are essential for cell fitness, while nodes colored in dark gray are non-essential or have increased growth rates upon knockout. Arrows highlighting potential disruption of oncogenic PPIs. Gray nodes indicate genes for which high confidence CRISPR based fitness data was not available. (E) Fitness scores for mutant residues derived from KRAS. Functional regions sourced from UniProt are overlaid above WT fitness. Dots indicate mutant amino acid fitness scores which were significantly depleted during the pooled screen (F) Comparison of mutant fitness scores derived from peptide screening data, with fitness scores derived from deep mutational scan data in a TP53 null cell line. After filtering out TP53 mutants with little effect on cell fitness in the deep mutational scan (absolute fitness scores <0.5), inferred TP53 functionality is significantly correlated with mutant peptide derived fitness (Pearson, P=0.045), supporting the hypothesis that peptide screening can be used to identify functionally important residues in the context of cancer cell fitness.

In order to mine potentially translatable dominant negative peptide motifs in a more systematic fashion a library of 43,441 peptides was synthesized (FIG. 2A SEQ ID NOs:1-9459) derived from key oncogenic driver genes with a high prevalence in TCGA sequencing data. This library covers ~20% of all high confidence cancer drivers identified in a recent computational approach, allowing for a more comprehensive characterization of potential oncogene derived dominant negative inhibitors of proliferation. This expanded screen identified many peptides with fitness defects (as measured by log fold depletion) an order of magnitude greater than those identified in the smaller pilot screen (FIG. 2A).

Figure 2B:
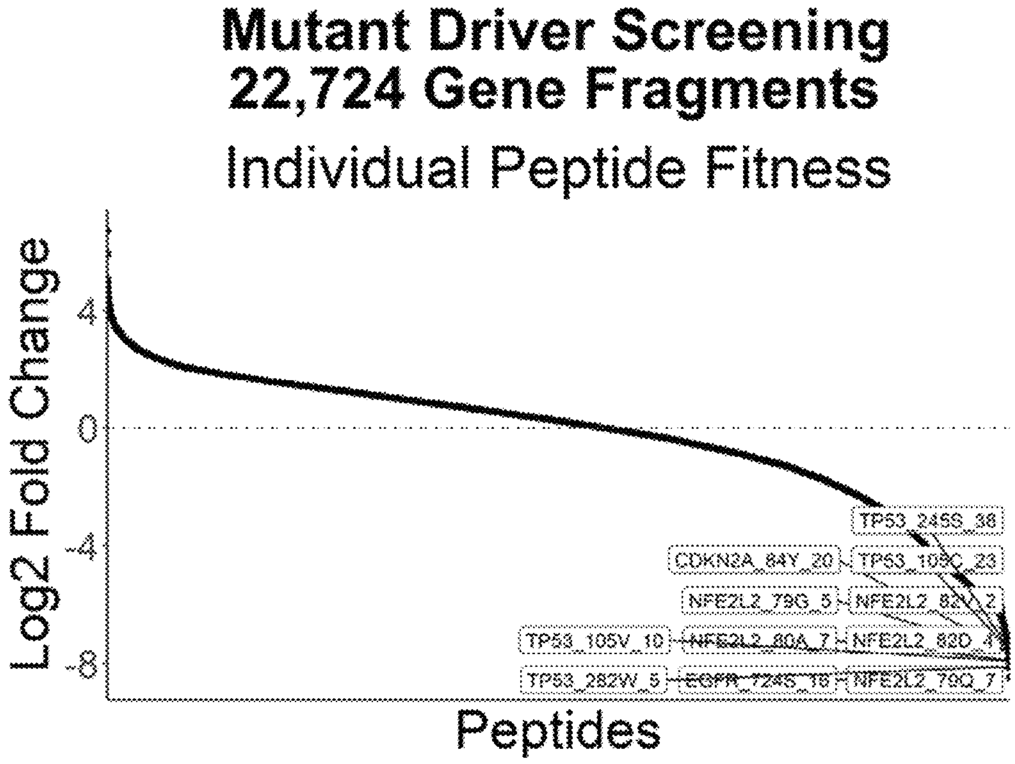
Figure 2C:
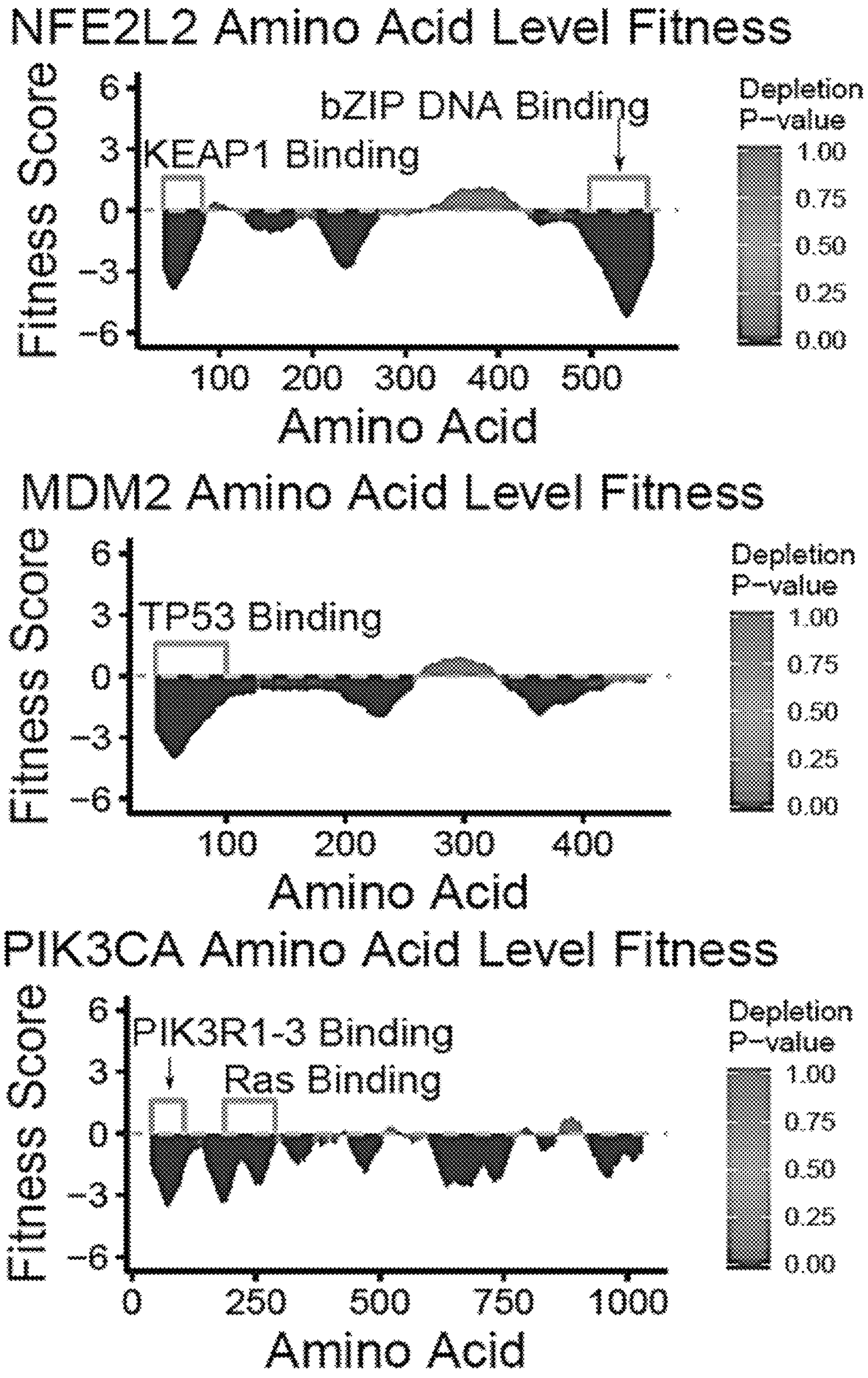

Peptides were also mapped from the library back to the WT protein's primary structure to visualize domains with a significant impact on cell fitness (FIG. 2C). First, the pattern of depletion for the transcription factor NFE2L2, the protein containing the most deleterious domains as scored by this screen, was examined. Peptides derived from the DNA binding domain, as well as the KEAP1 binding domain of NFE2L2 were highly depleted in the screen, consistent with the critical role these regions play in mediating NFE2L2 function. NFE2L2 has been previously shown to support cellular proliferation and metastasis in MDA-MB-231 cells, supporting the conclusion that a peptide inhibitor of NFE2L2 could be used to inhibit cell growth. The fitness of peptides derived from MDM2 were also examined. MDM2 is a negative regulator of TP53 function in the cell, and inhibition of the MDM2-TP53 PPI has been shown to effectively oppose cancer growth across a variety of malignancies. In the screening data, peptides derived from the TP53 binding domain of MDM2 were significantly depleted consistent with previous reports that truncated MDM2 proteins containing only the N-terminus function as dominant negatives. The PI3K-AKT-mTOR pathway is one of the most frequently dysregulated pathways in cancer, and PIK3CA plays a pivotal role in signal transduction along this pathway. The most critical region impacting cell fitness in PIK3CA corresponds to the adaptor binding domain of the protein. PIK3CA activity is modulated by the binding of various adaptor proteins encoded by genes such as PIK3R1, PIK3R2 and PIK3R3. Supporting the hypothesis that these peptides potentially inhibit proliferation via disruption of the PIK3CA/PIK3R1-3 complex, the corresponding PIK3CA binding domain in PIK3R1 is also depleted. The depleted domains for DICER1 were also plotted. Regions corresponding to binding sites for known DICER1 cofactors TARBP and PRKRA were heavily depleted, comprising some of the most deleterious peptides in the screen. This data supports the growing understanding of the oncogenic role miRNAs and other epigenetic regulators play in tumorigenesis. Surprisingly, the tumor suppressor RB1 contained domains which were highly deleterious to cell fitness. The N-terminal RbN domains were both highly depleted, potentially due to previously described allosteric interactions with the cell cycle regulatory transcription factor E2F49. ERBB4 had a pattern of depletion similar to EGFR, with overexpression of peptides derived from the ERBB4 regulatory P-loop and Alpha C-helix resulting in a significant fitness defect, highlighting the importance of this region in ERBB dimerization and proliferative signaling. Peptides from this screen were analyzed for their impact on cancer driver specific signaling networks (FIG. 2D) using publicly available PPI data from STRING, with nodes colored by gene fitness data sourced from DepMap CRISPR knockout screening. Notably, using this data, peptide motifs were identified that interfere with important PPI interfaces mediating signal transduction between cancer drivers previously identified as essential for cell fitness.

Figure 2D:
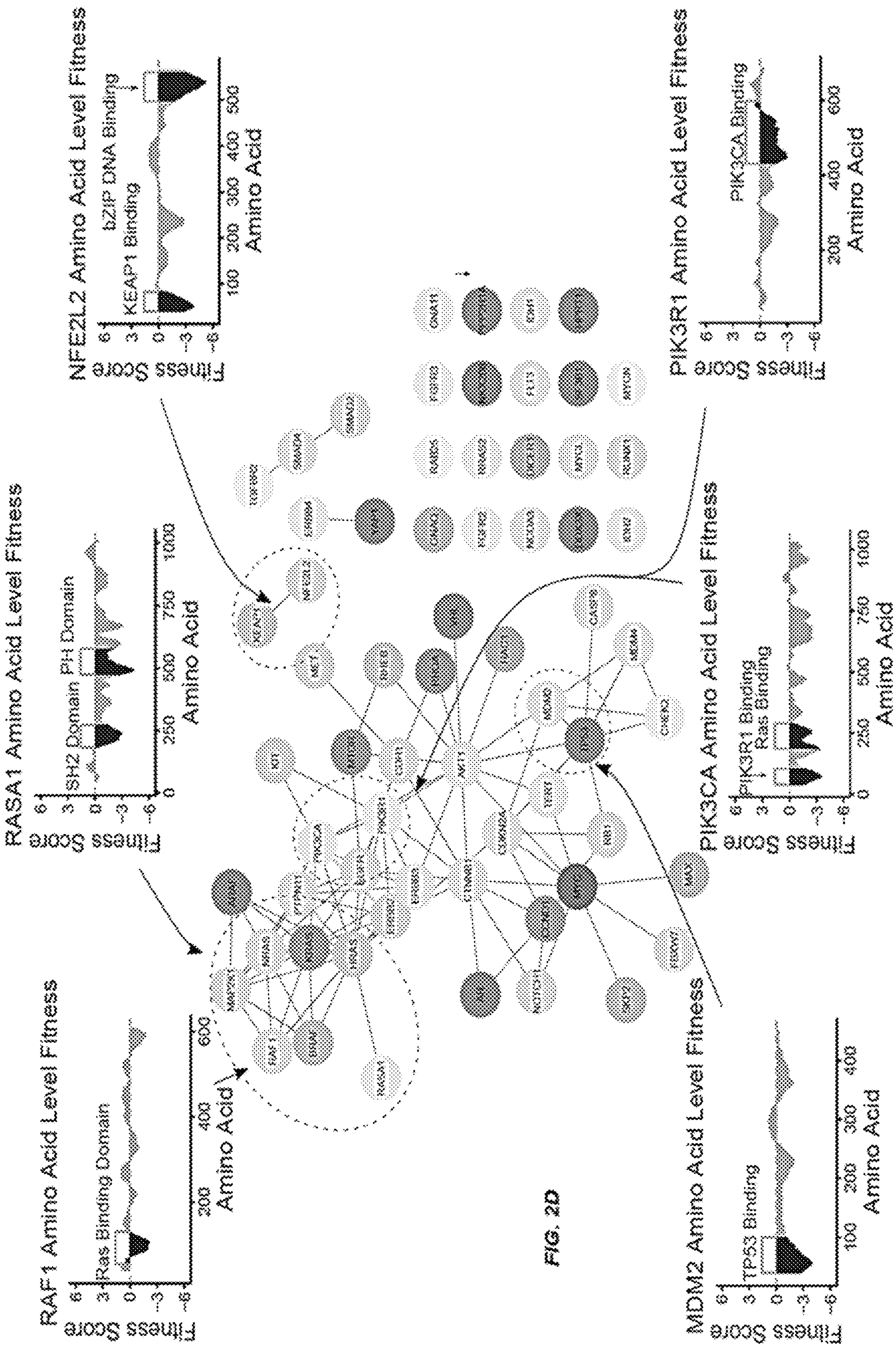
Figure 2E:
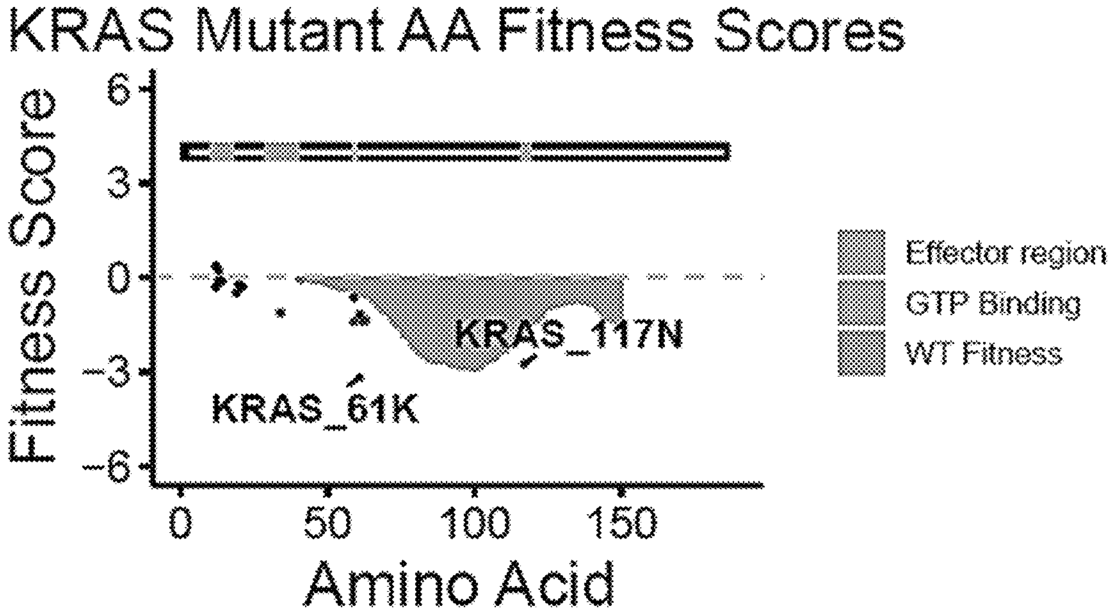
Figure 2F:
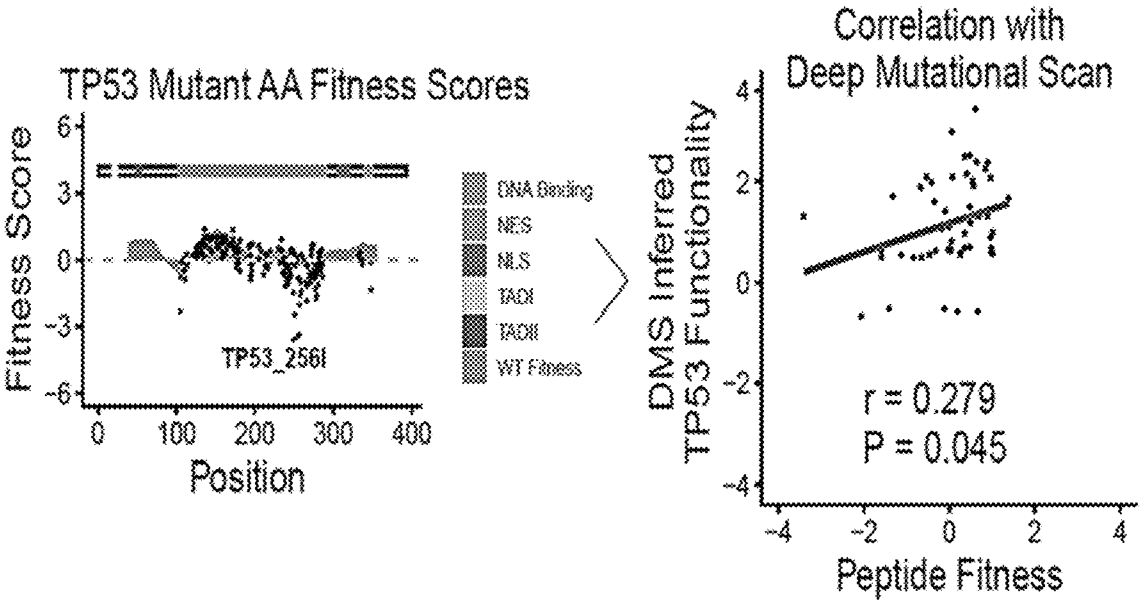
Figure 6B:
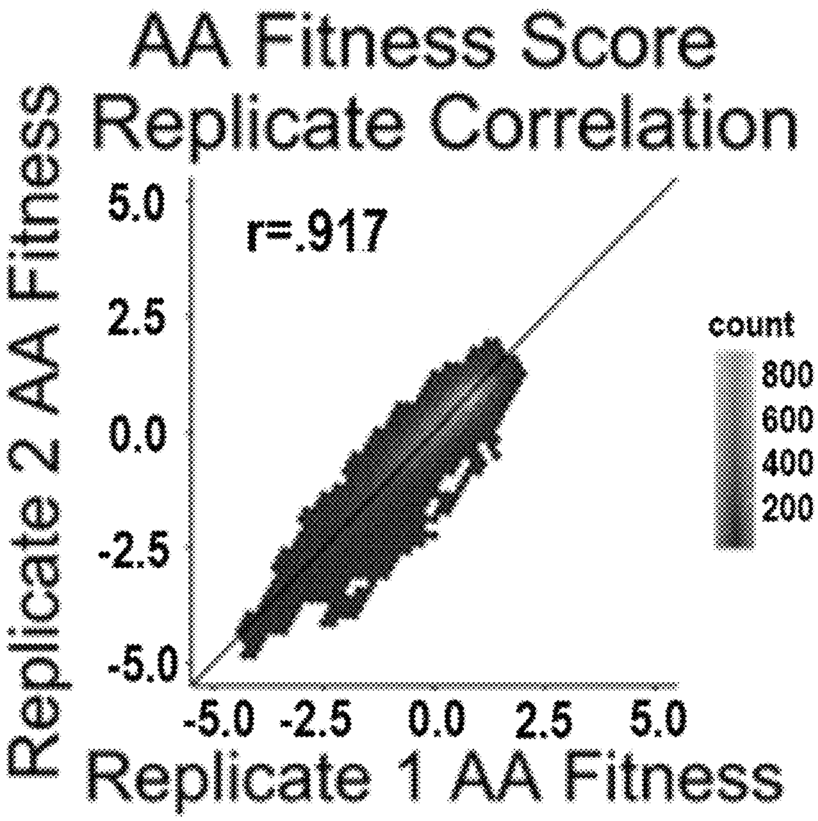
Figure 6C:
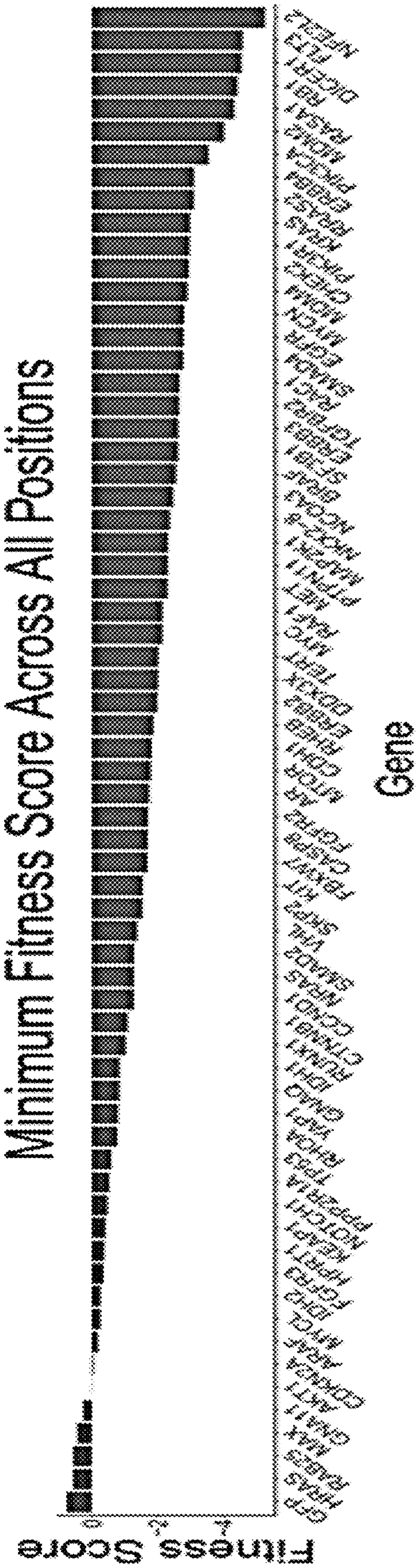
Figure 6D:
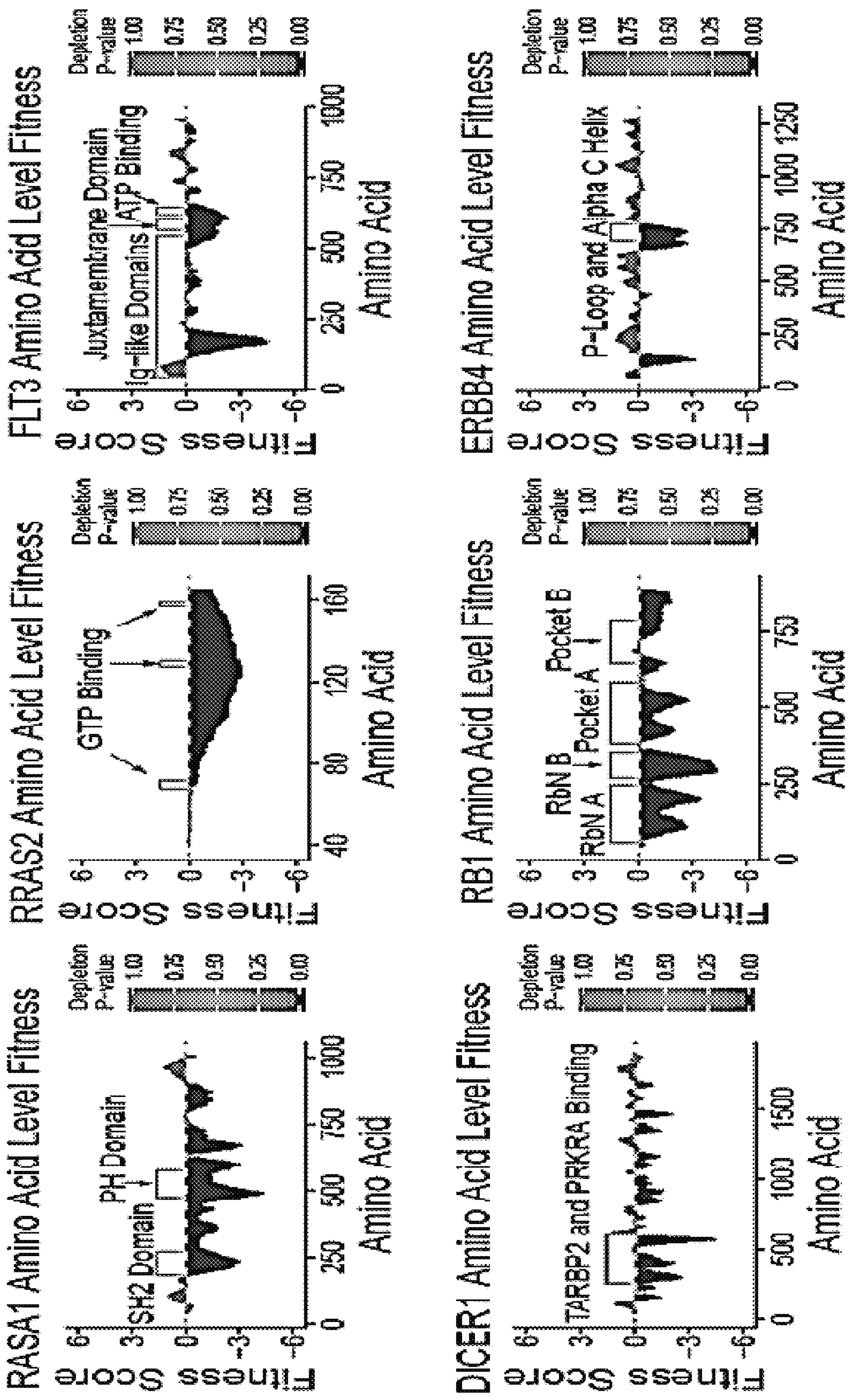
Figure 6F:
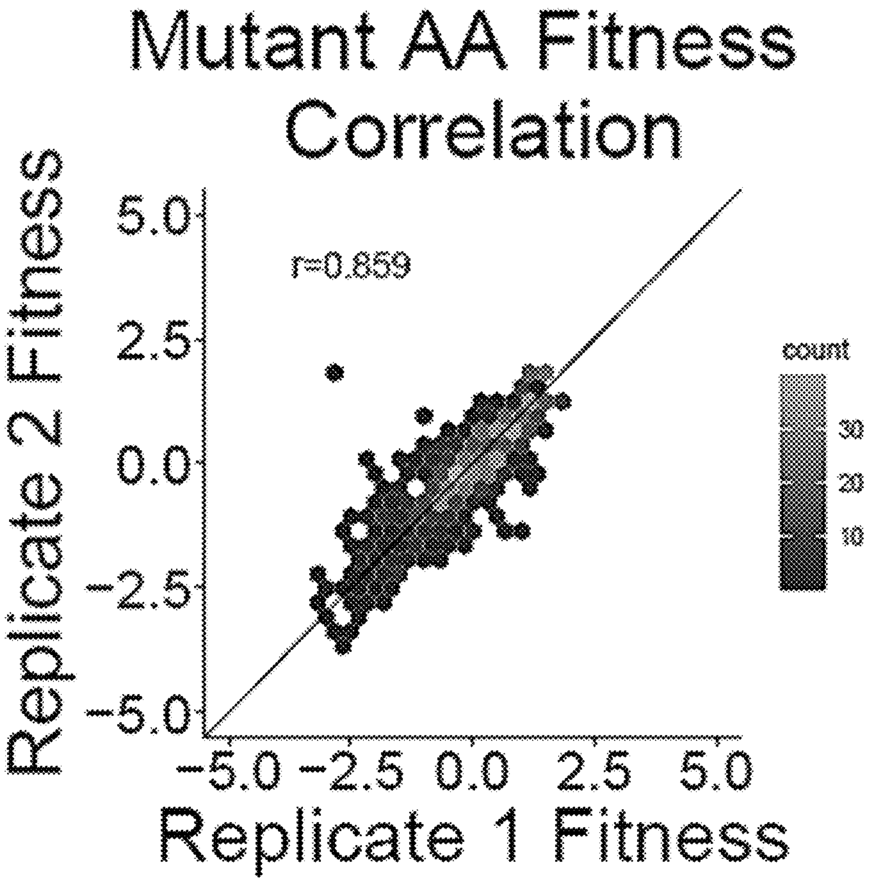
Figure 6G:
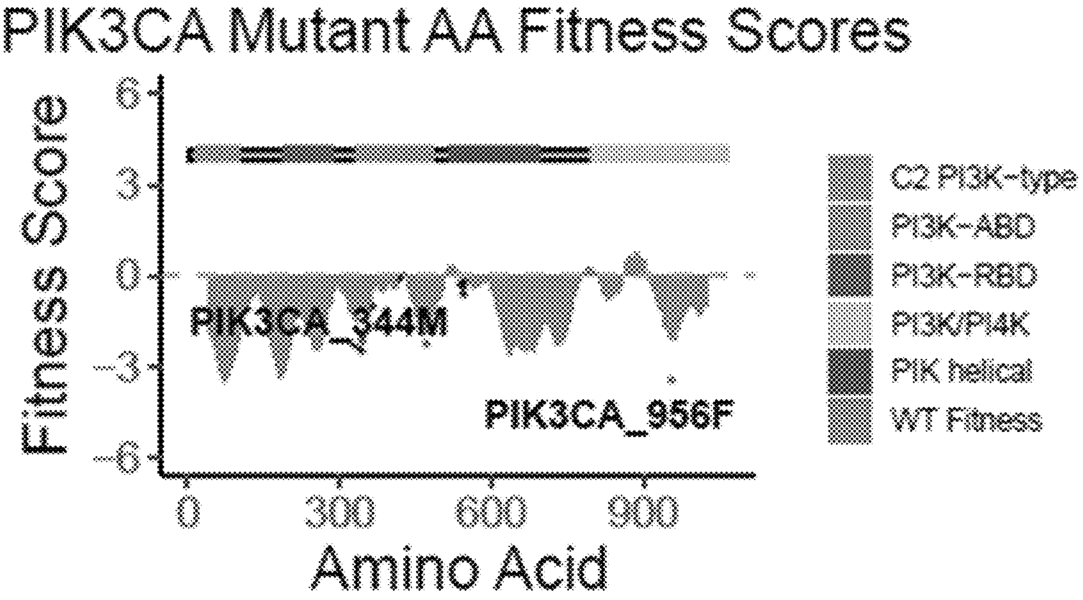
Figure 6G:
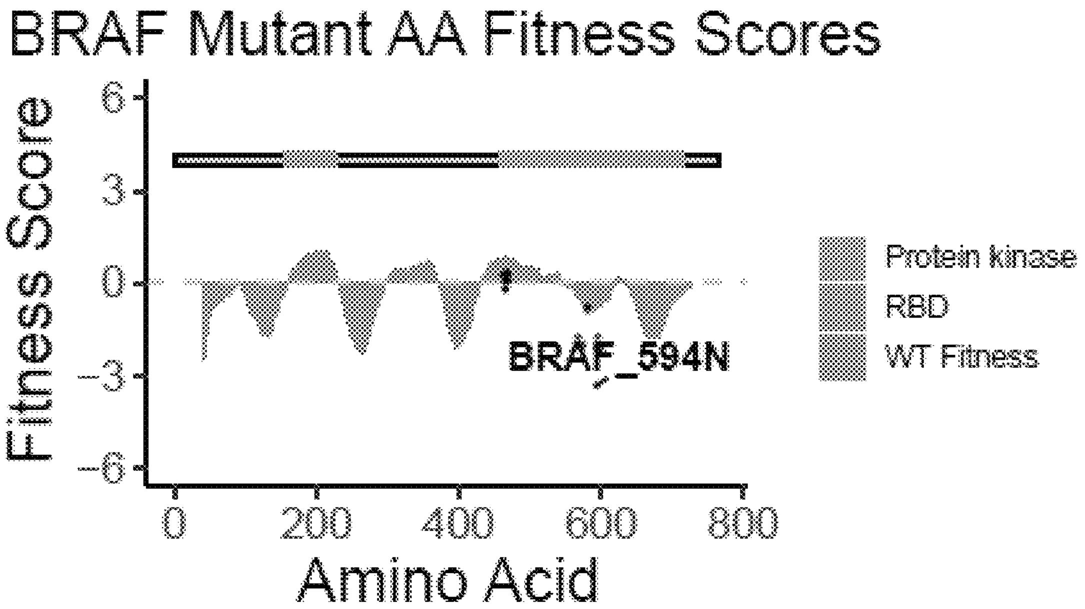
Figure 6G:
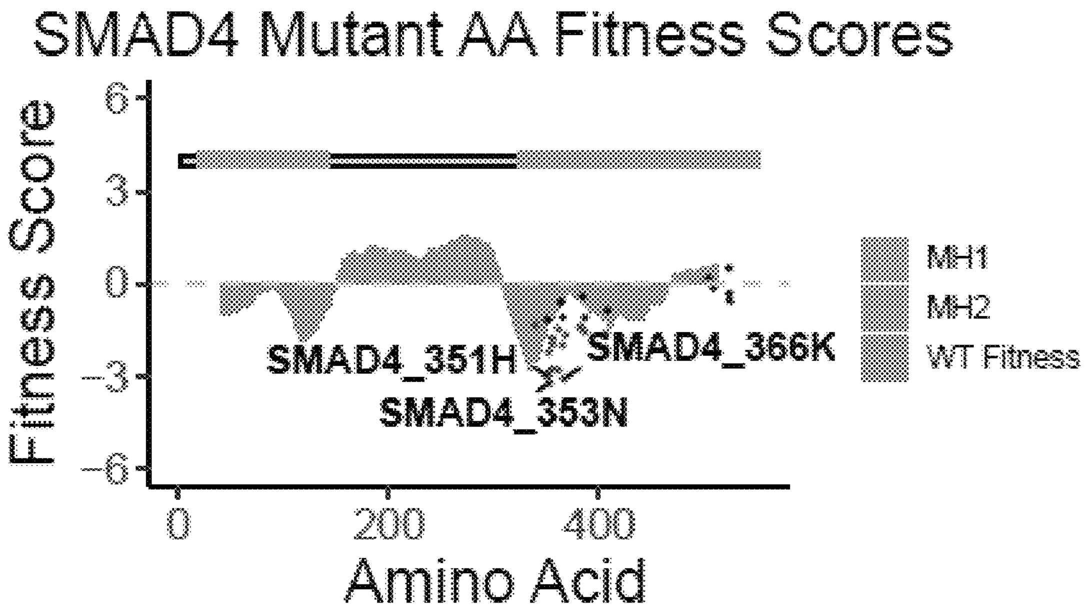

Building on this screen of cancer drivers, a library of peptides derived from high confidence cancer driver mutations identified via The Cancer Genome Atlas sequencing data, was also generated. This screen interrogated 579 mutant residues across 53 cancer driver genes, via 22,724 peptide coding gene fragments (FIG. 2B, E-F, 6E-G). In most cases mutant peptides had a similar effect on cell fitness compared to their wildtype counterparts. However, some mutants such as PIK3CA956F, the aforementioned KRAS61K, and BRAF594N showed markedly more deleterious effects on cell fitness (FIG. 2E, 6G). To further validate that the peptide over-expression platform can identify biophysical features relevant to the protein from which they were derived, the mutant TP53 peptide data was compared with existing TP53 deep mutational scan (DMS) data (FIG. 2F). After first filtering the DMS data for only TP53 mutants with a high magnitude of effect on cell fitness (absolute fitness value >0.5), the fitness of the corresponding mutant peptides was compared to the screen data as described herein. Even with the highly dissimilar screening modalities, significant correlation (Pearson r=0.279; P=0.045) between the predicted mutant TP53 functionality from the DMS data to the mutant TP53 peptide fitness. This indicates TP53 mutants expected to be functional (either through gain of oncogenic function or retention of WT function), generate mutant peptides with functionality consistent with the parental structure from which they were derived. Together, these results highlight a major utility of this approach, e.g., the ability to interrogate user defined peptide sequences as opposed to those present only in WT protein structures.

A similar library of dominant negative peptides was generated against ACE2 as a target to prevent SARs-Cov2 infection (see, SEQ ID NOs: 9460-9489).

Figure 4A:
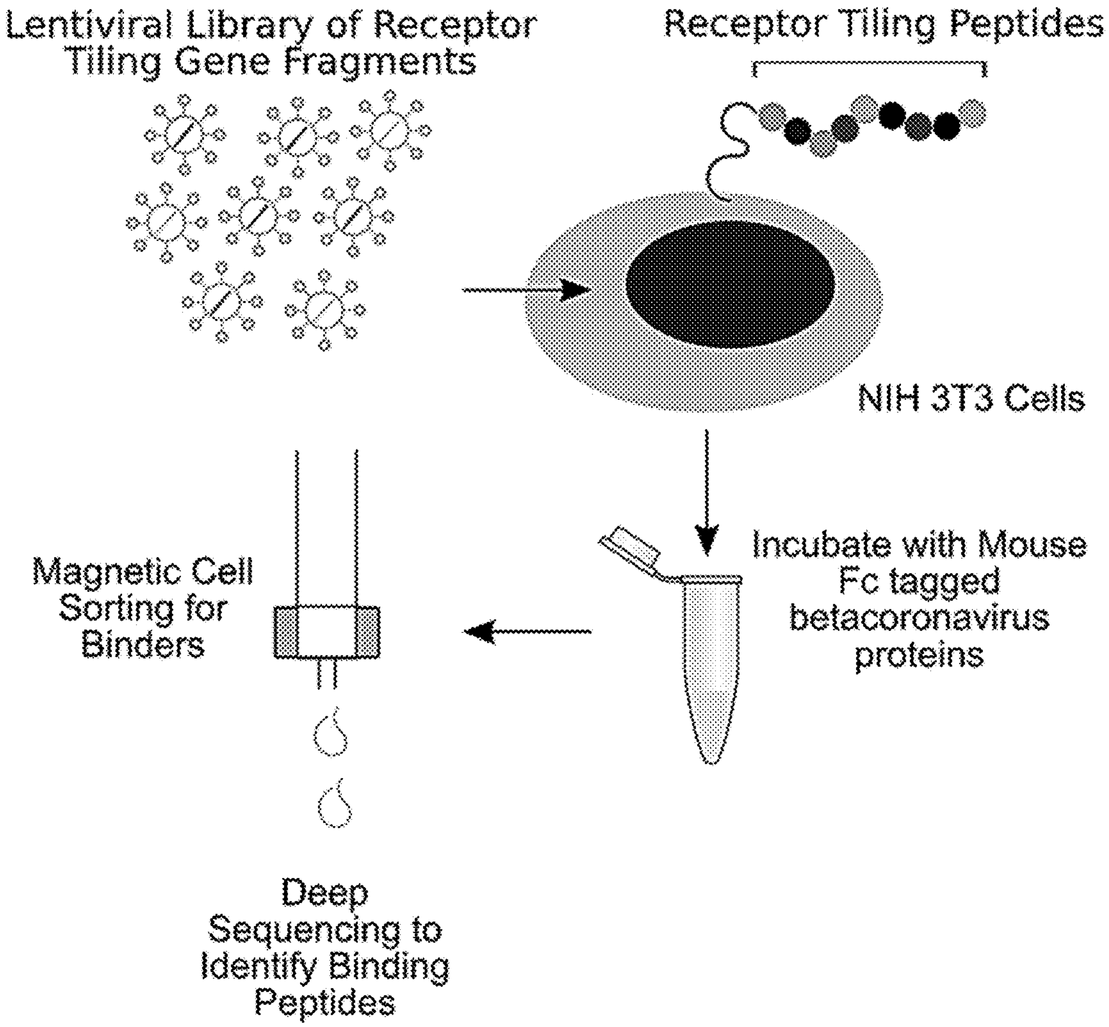
FIG. 4A-E shows PepTile based mapping of Betacoronavirus spike protein and host receptor interactions, and facilitating of downstream peptide bioproduction: (A) Schematic illustrating experimental strategy to probe human receptors for Betacoronavirus binding domains. Peptides derived from receptors (plus homologs) implicated in coronavirus cell entry were expressed on the cell surface, and screened for binding mouse Fc tagged full length coronavirus spike proteins, as well as mouse Fc tagged RBD domains. Enrichment of cells expressing binding peptides was accomplished via magnetic activated cell sorting after incubation with anti-mouse Fc magnetic beads. (B) Fluorescent images showing cell surface localization of HaloTag construct cloned into cell surface expression vector. HEK293T cells were transfected with the cell surface HaloTag construct, and subsequently incubated with AlexaFluor488 labeled HaloTag ligand to visualize protein localization. (C) Plot showing consensus peptides enriched in the bound fraction for both the full-length spike protein as well as the RBD domain. Highly enriched ACE2 derived peptides are highlighted. (D) Hit peptides derived from ACE2 are shown overlaid on the protein crystal structure in complex with SARS-Cov2 spike protein. Shown is ACE2_28; ACE2_72; ACE2_314/ACE2_315, ACE2_654/655; ACE2_591; ACE2_418; ACE2_452. (E) Peptide production protocol to facilitate translation of peptide hits. Tagless peptides conjugated to cell penetrating protein TAT were produced at high purity via fusion to Maltose Binding Protein (MBP), and subsequent cleavage by TEV protease. The protocol makes use of no specialized instruments, and is easily adaptable to alternative cell penetrating motifs or peptide constructs. Ladder has bands marking 10, 15, 20, 25, 37, 50, 75, 100, 150, and 250 kD.
Figure 4B:
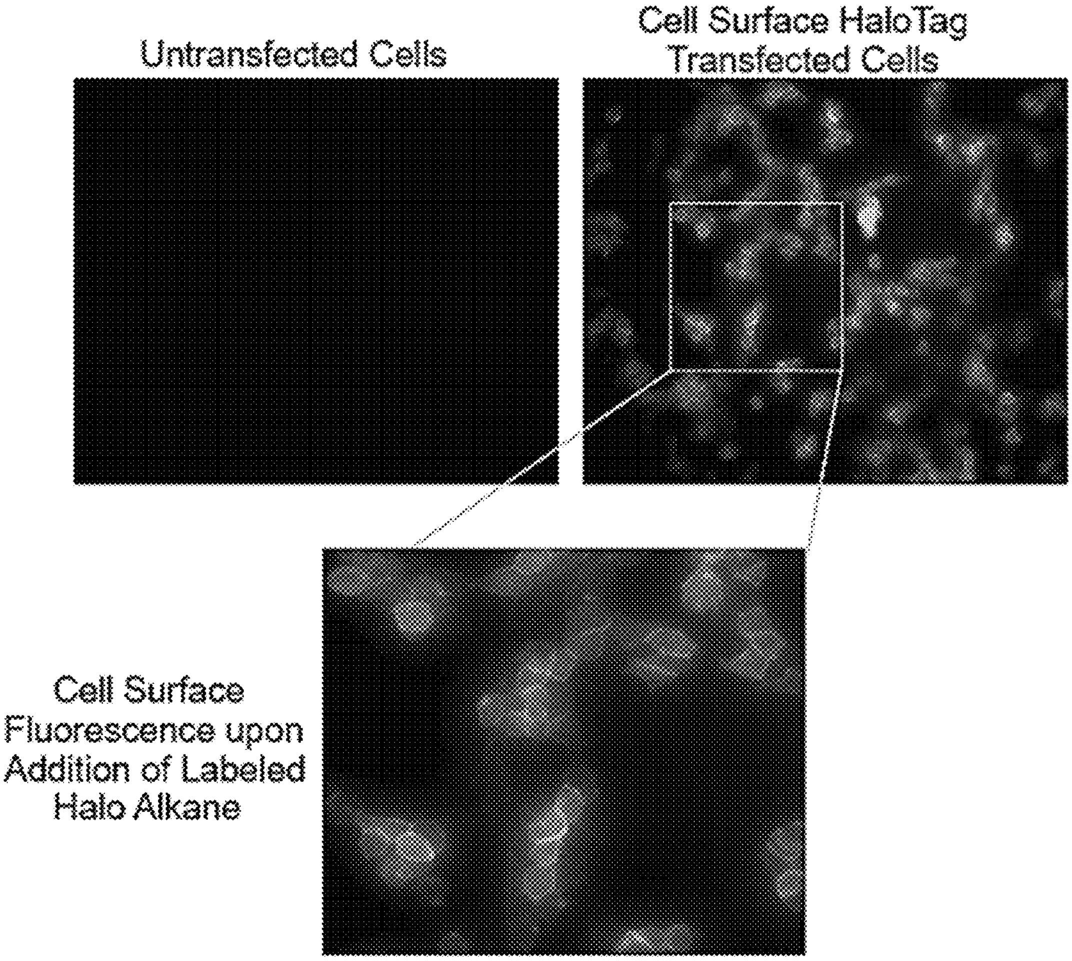
Figure 7A:
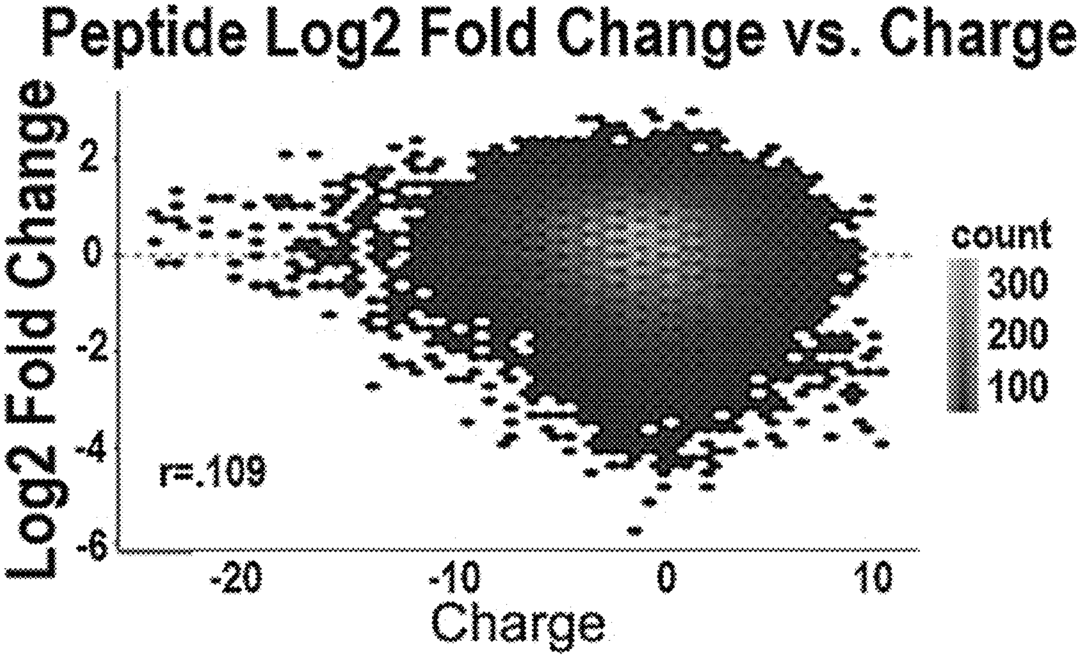
Figure 7B:
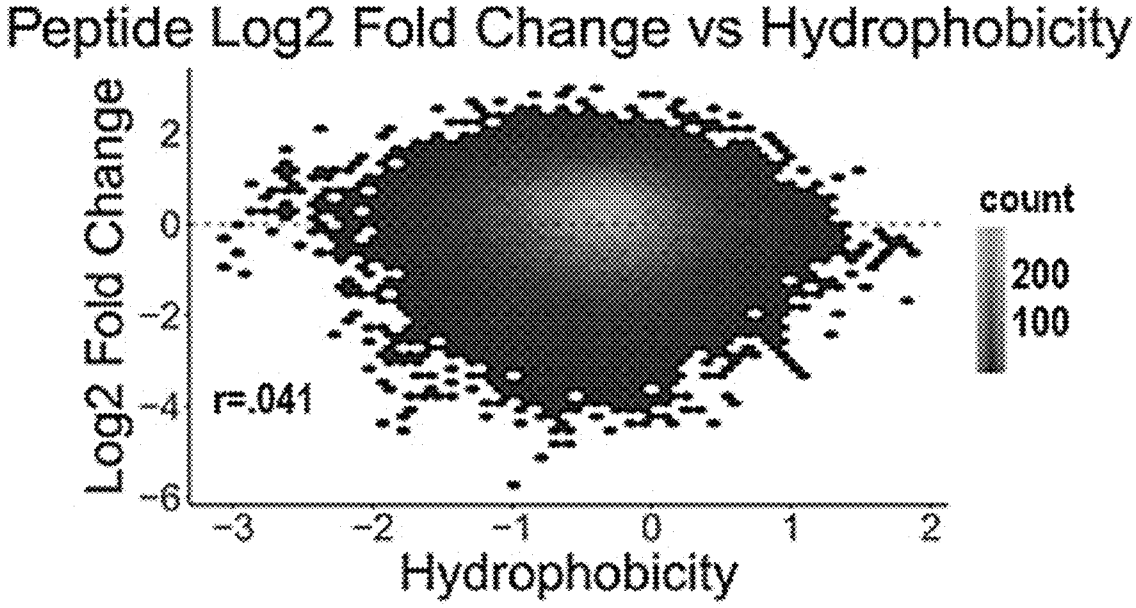
Figure 7C:
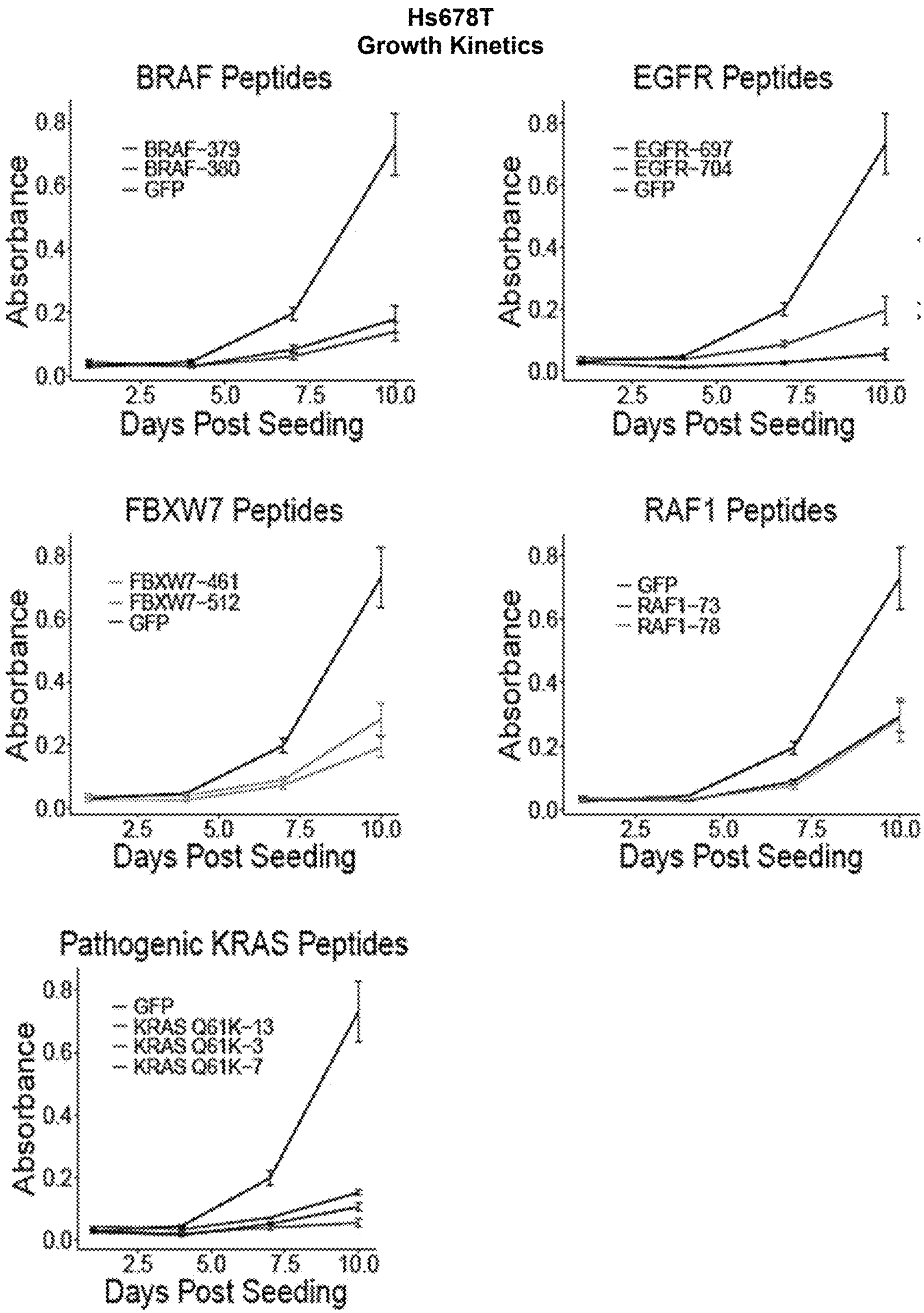
Figure 7D:
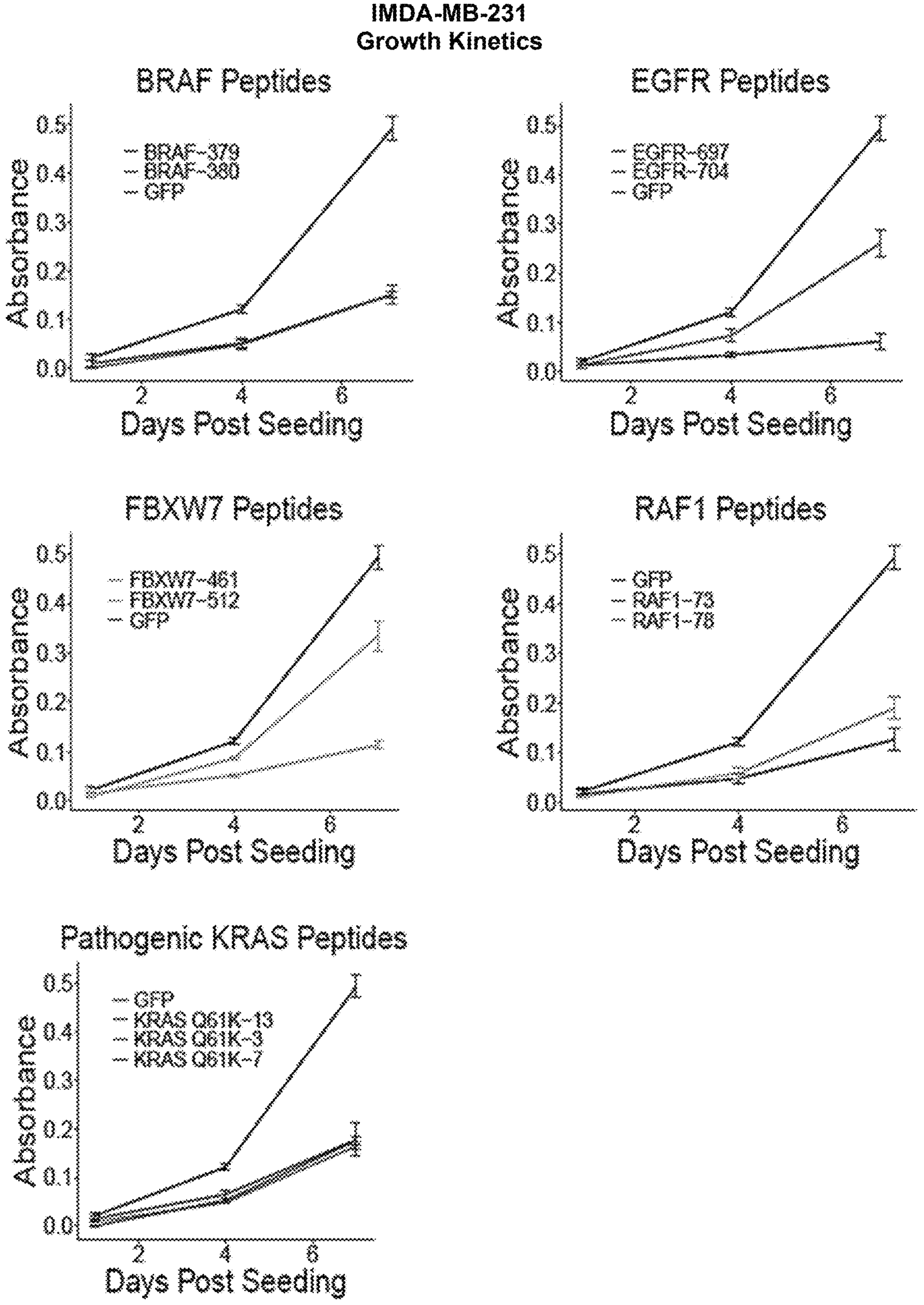

Validation of the anti-proliferative effects of the peptides were tested via a complementary technology other than sequencing. Specifically, after transduction with putative anti-proliferative gene fragments derived from WT proteins, Hs578T cells and MDA-MB-231 cells were seeded in 96 well plates (n=4-8) and grown for 7 days, with proliferation measured via the colorimetric WST-8 assay (FIG. 3A, 7C-D, and Table 6). All peptides tested had significant growth defects in both cell lines compared to infection with the GFP control plasmid. EGFR-697 specifically was deleterious to cell growth in both cell lines. Three peptides derived from the KRAS Q61K mutant protein (KRAS61K-3, KRAS61K-7, and KRAS61K-13) were similarly tested, all of which significantly reduced cell growth in both cell lines (FIG. 4A-B). To test the specificity of these perturbations, MCF-7 cells were transduced with EGFR-697 and RAF1-73. MCF-7 cells show a reduced fitness defect upon overexpression of EGFR-697, consistent with previous reports showing MCF-7 cells are less sensitive than Hs578T and MDA-MB-231 cells to the EGFR inhibitor Gefitinib. As well, HEK293T cells transduced with EGFR-697 and RAF1-73 showed no growth defects, further indicating this screening methodology identifies context dependent inhibitors of cellular proliferation rather than generally toxic peptide motifs.

TABLE 6

Peptides/Proteins validated via lentiviral overexpression

| Gene Name | Amino Acid Sequence |
|---|---|
| BRAF-379 | MIDDLIRDQGFRGDGGSTTGL SATPPASLPGSLTNVKALQK (SEQ ID NO: 9524) |
| BRAF-380 | MDDLIRDQGFRGDGGSTTGLS ATPPASLPGSLTNVKALQKS (SEQ ID NO: 9525) |
| EGFR-697 | MEAPNQALLRILKETEFKKIK VLGSGAFGTVYKGLWIPEGE (SEQ ID NO: 9526) |
| EGFR-704 | MLRILKETEFKKIKVLGSGAF GTVYKGLWIPEGEKVKIPVA (SEQ ID NO: 9527) |
| FBXW7-461 | MTSTVRCMHLHEKRVVSGSRD ATLRVWDIETGQCLHVLMGH (SEQ ID NO: 9528) |
| FBXW7-512 | MRRVVSGAYDFMVKVWDPETE TCLHTLQGHTNRVYSLQFDG (SEQ ID NO: 9529) |
| RAF1-73 | MRNGMSLHDCLMKALKVRGLQ PECCAVFRLLHEHKGKKARL (SEQ ID NO: 9530) |
| RAF1-78 | MLHDCLMKALKVRGLQPECCA VFRLLHEHKGKKARLDWNTD (SEQ ID NO: 9531) |
| KRAS61K-3 | MIQNHFVDEYDPTIEDSYRKQ VVIDGETCLLDILDTAGKEE (SEQ ID NO: 9532) |
| KRAS61K-7 | MFVDEYDPTIEDSYRKQVVID GETCLLDILDTAGKEEYSAM (SEQ ID NO: 9533) |
| KRAS61K-13 | MPTIEDSYRKQVVIDGETCLL DILDTAGKEEYSAMRDQYMR (SEQ ID NO: 9534) |
| DICER1-552 | MRARAPISNYIMLADTDKIKS FEEDLKTYKAIEKILRNKCS (SEQ ID NO: 9535) |
| KRAS-143 | METSAKTRQGVDDAFYTLVRE IRKHKEKMSKDGKKKKKKSK (SEQ ID NO: 9536) |
| MDM2-25 | METLVRPKPLLLKLLKSVGAQ KDTYTMKEVLFYLGQYIMTK (SEQ ID NO: 9537) |
| RASA1-468 | MKDAFYKNIVKKGYLLKKGKG KRWKNLYFILEGSDAQLIYF (SEQ ID NO: 9538) |

RNA-sequencing on Hs578T cells genetically engineered to overexpress the most deleterious gene fragment identified, EGFR-697, were sequenced. 225 genes were differentially expressed (BH adjusted P-value <0.05), and gene set enrichment analysis (GSEA) was performed to identify upregulation and downregulation of genetic pathways. 239 KEGG pathways corresponding to cell signaling and metabolism were tested, with 22 pathways showing significant (False Discovery Rate <0.025) enrichment/depletion in cells expressing EGFR-697 compared to control cells transduced with GFP. Several metabolic pathways relating to oxidative phosphorylation and carbon metabolism were downregulated, consistent with the role of oncogenic EGFR signaling as a driver of metabolic alterations. Furthermore, genes relating to DNA replication were also downregulated, consistent with the observed slow growing phenotype.

Figure 4C:
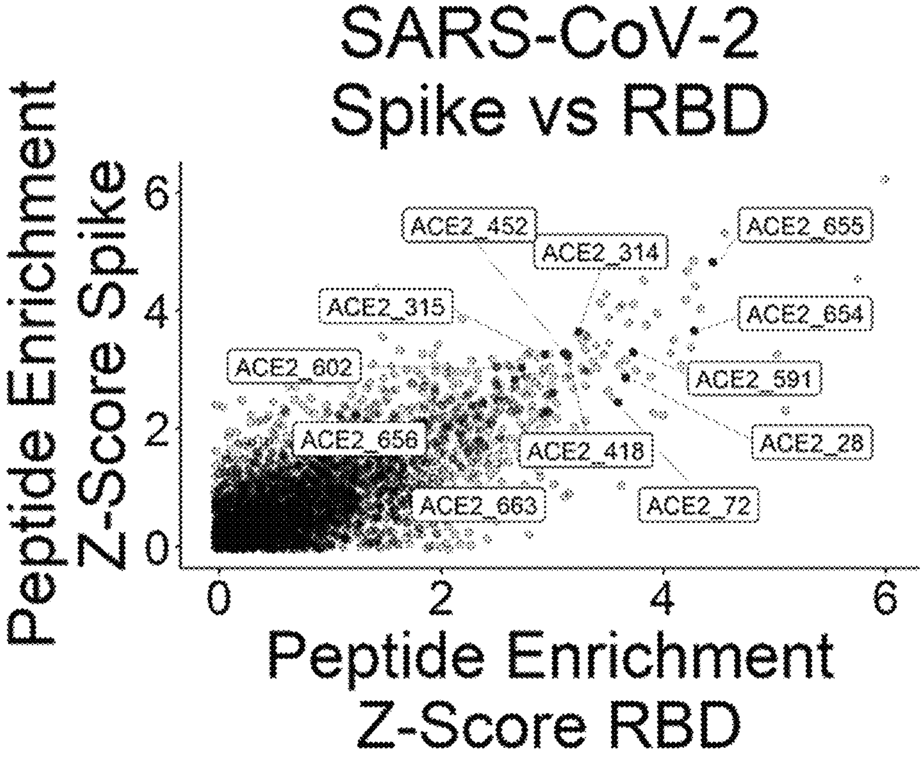

After validating the inhibitory activity of these peptide constructs when overexpressed genetically, experiments were performed to see if the peptides could be exogenously delivered as anti-cancer therapeutics. Towards this, EGFR-697 as well as RAF1-73 peptides were chemically synthesized, and their ability to inhibit cell growth measured when conjugated to the TAT cell penetrating protein transduction domain. (FIG. 4C, Table 6). The best performing peptide from the genetic validations, EGFR-697, maintained its anti-proliferative effects when delivered exogenously (FIG. 2D). The IC50s of the peptide (33.3 μM for Hs578T and 63 μM for MDA-MB-231) were comparable to other FDA approved EGFR inhibitors in these cell lines, highlighting the translational potential of this methodology. Moreover, RAF1-73 was also deleterious to cell growth, with $IC_{50}$ values of 27.0 μM and 32.6 μM for Hs578T and MDA-MB-231 respectively.

Figure 3C:
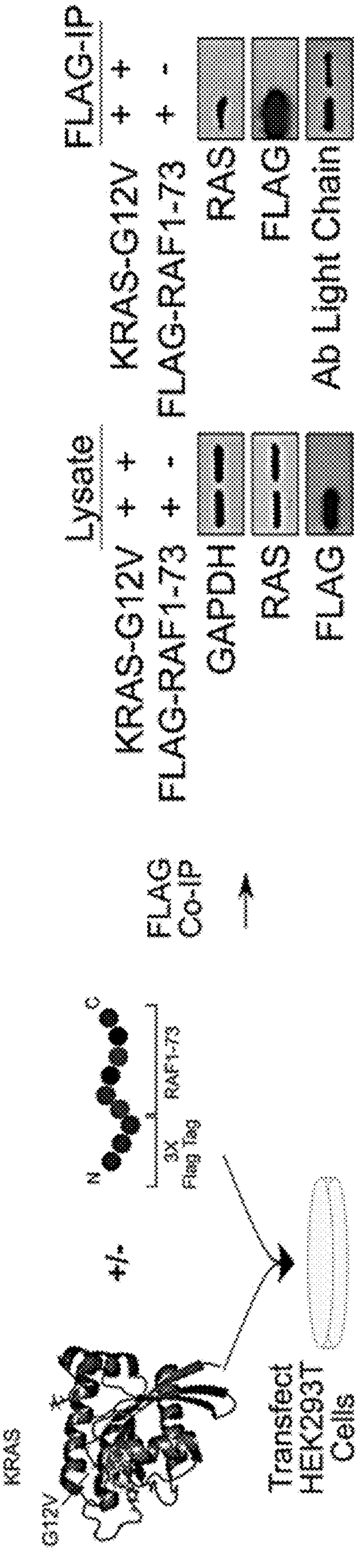
Figure 3D:
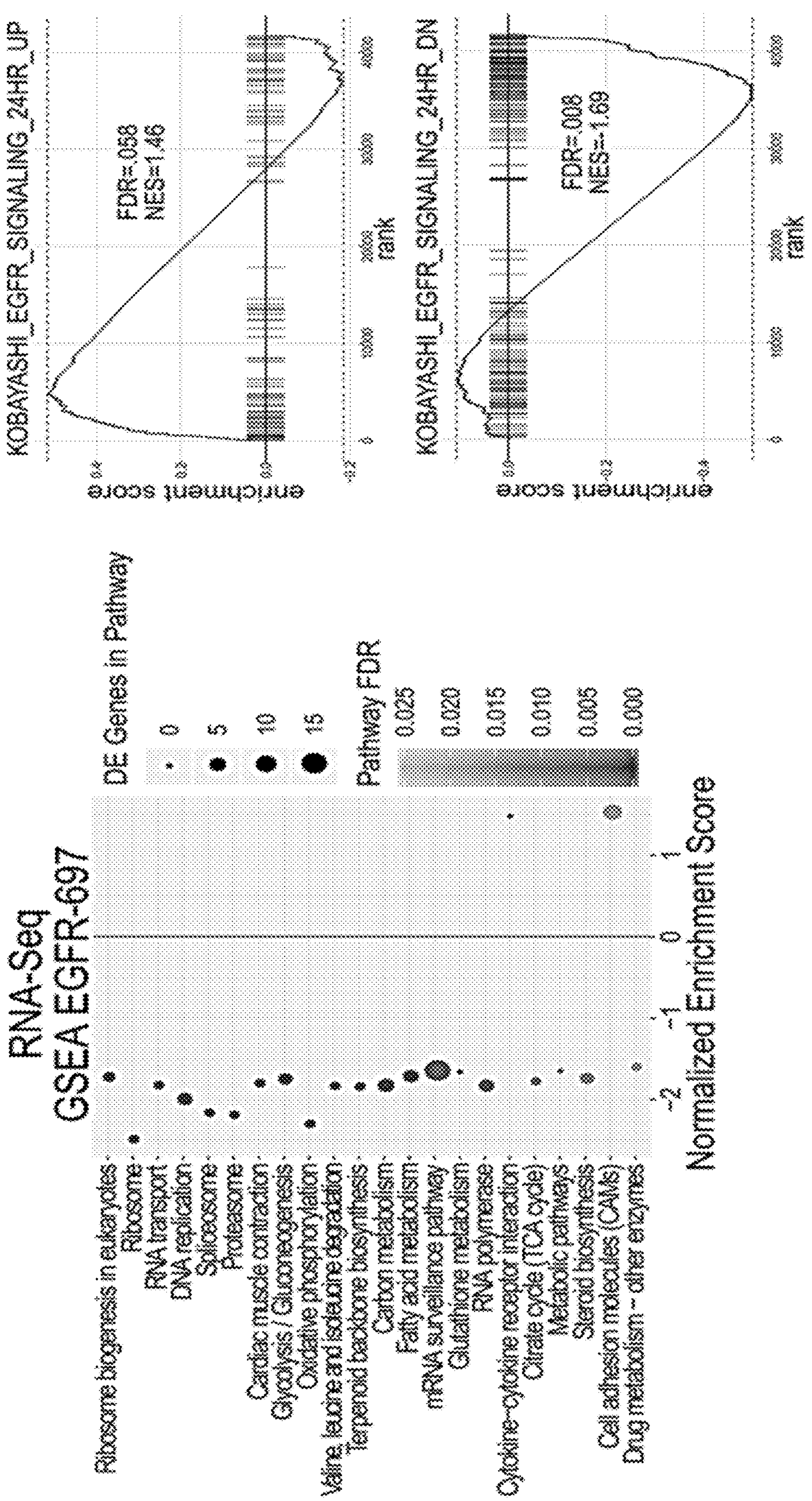
Figure 7E:
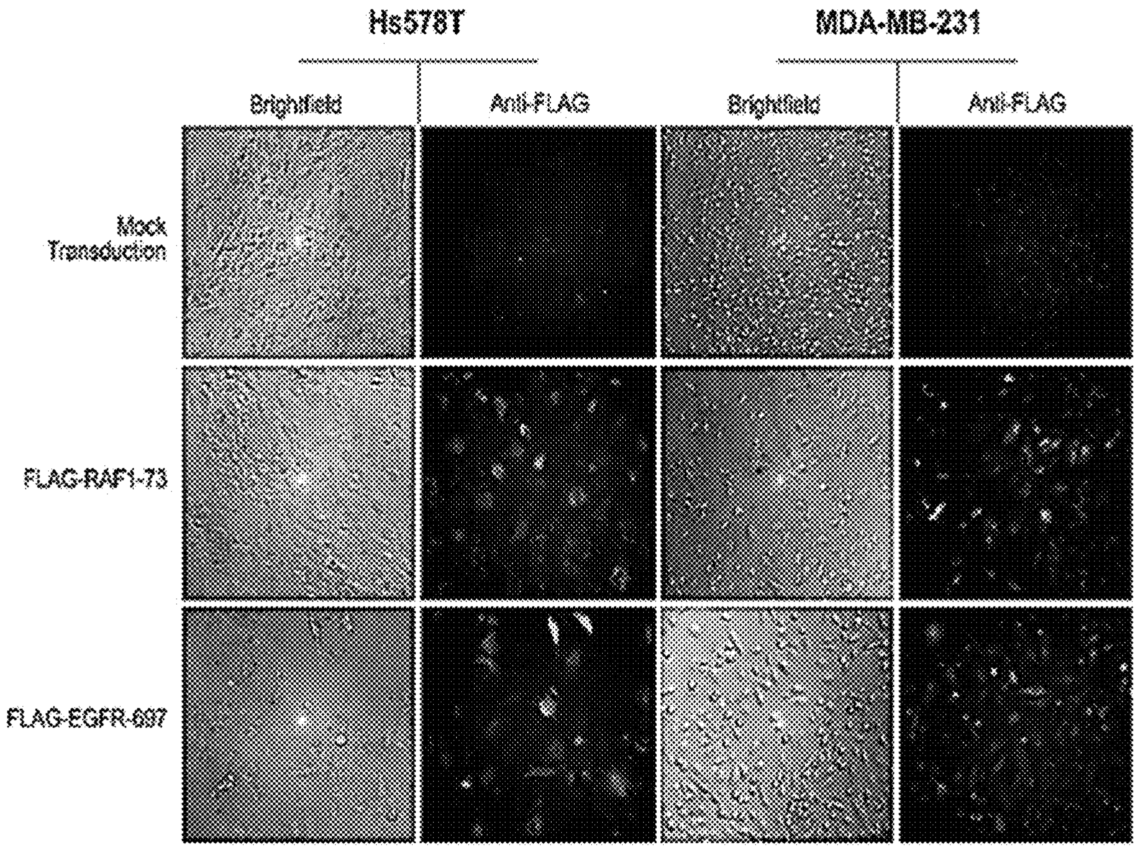

Experiments were performed to validate the hypothesis that the functionality of these putative inhibitory peptides was dependent on the role and structure of the WT protein domain they were derived from. First, 3×FLAG tagged versions of the RAF1-73 and EGFR-697 peptides were generated to verify these constructs had robust expression when overexpressed via lentivirus in Hs578T and MDA-MB-231 cells (FIG. 7E). These peptides showed detectable expression 72 hours after transduction, indicating the EF1αpromoter can drive robust expression of small peptides. After validating that these constructs were well expressed, experiments were performed to determine whether the peptides derived from protein domains retained domain specific biological activities. Specifically, experiments were performed to determine whether the RAF1-73 peptide (derived from the RAF1 Ras binding domain) retained the ability of the full-length domain to bind activated Ras proteins. To evaluate this potential interaction, HEK293T cells were co-transfected with the constitutively active KRAS G12V mutant and 3×FLAG-RAF1-73, then performed a co-immunoprecipitation using anti-FLAG agarose beads (FIG. 3C). Western blot analysis of the immunoprecipitated protein complexes subsequently verified the protein-protein interaction between RAF1-73 and Ras. In order to better understand mechanistically how the EGFR-697 peptide functions, RNA-sequencing was conducted on Hs578T cells modified via lentivirus to overexpress EGFR-697. 225 differentially expressed genes (BH adjusted P-value <0.05) were identified. Gene set enrichment analysis (GSEA) was performed to identify upregulation and downregulation of genetic pathways. 239 KEGG pathways corresponding to cell signaling and metabolism were tested, with 22 pathways showing highly significant (False Discovery Rate <0.025) upregulation/downregulation in cells expressing EGFR-697 compared to control cells transduced with GFP (FIG. 3D). Several metabolic pathways relating to oxidative phosphorylation and carbon metabolism were downregulated, consistent with the role of oncogenic EGFR signaling as a driver of metabolic alterations. Furthermore, genes relating to DNA replication were also downregulated, consistent with the observed slow growing phenotype. In addition to performing GSEA on KEGG pathways, a set of curated genes from the Molecular Signatures Database comprised of genes significantly downregulated/upregulated in H1975 cells upon treatment with an irreversible EGFR inhibitor were also tested. EGFR-697 transduction in Hs578T cells resulted in downregulation of genes identified as downregulated in response to chemical EGFR inhibition, and upregulation of genes identified as upregulated (FDR=0.008 and FDR=0.058 respectively). Collectively, this supports the hypothesis the EGFR-697 peptide can perturb EGFR signaling.

Having demonstrated the applicability of this screening format for intracellular targets, experiments targeted extracellular proteins. Specifically, tiling and assaying gene fragments on the mammalian cell surface could help map receptor ligand interfaces in their native settings and define minimal functional domains, thus complementing in vitro and phage display based strategies. Experiments screening gene fragments of receptors of Betacoronaviruses were performed. This was motivated by 2 aspects: 1) The recent emergence of the SARS-coronavirus 2 (SARS-CoV-2) and its rapid spread that is posing a major global health emergency, and; 2) The ongoing challenges with engineering a therapeutic, including ones anticipated to have the most potency such as vaccines and neutralizing antibodies. It was conjectured that since the virus is an evolving entity but the cognate receptor in humans is relatively constant, a peptide sponge derived from the spike-protein receptor interface (mapped via PepTile screening) could be a putative viral inhibitory agent. Additionally: 1) it could be broadly active against multiple strains; 2) be non-immunogenic as it is human protein derived; 3) will not retain activity of the full-length native protein and thus not disrupt normal physiology if injected into the circulation; and 4) be couplable to protein domains with naturally long serum half-life such as Fc, transferrin or albumin to improve persistence and thereby therapeutic efficacy. Notably, a recent elegant study showed soluble full length ACE2 is able to inhibit SARS-CoV-2 infection, highlighting the potential of human protein scaffolds as a strategy for therapeutic intervention.

Figure 4D:
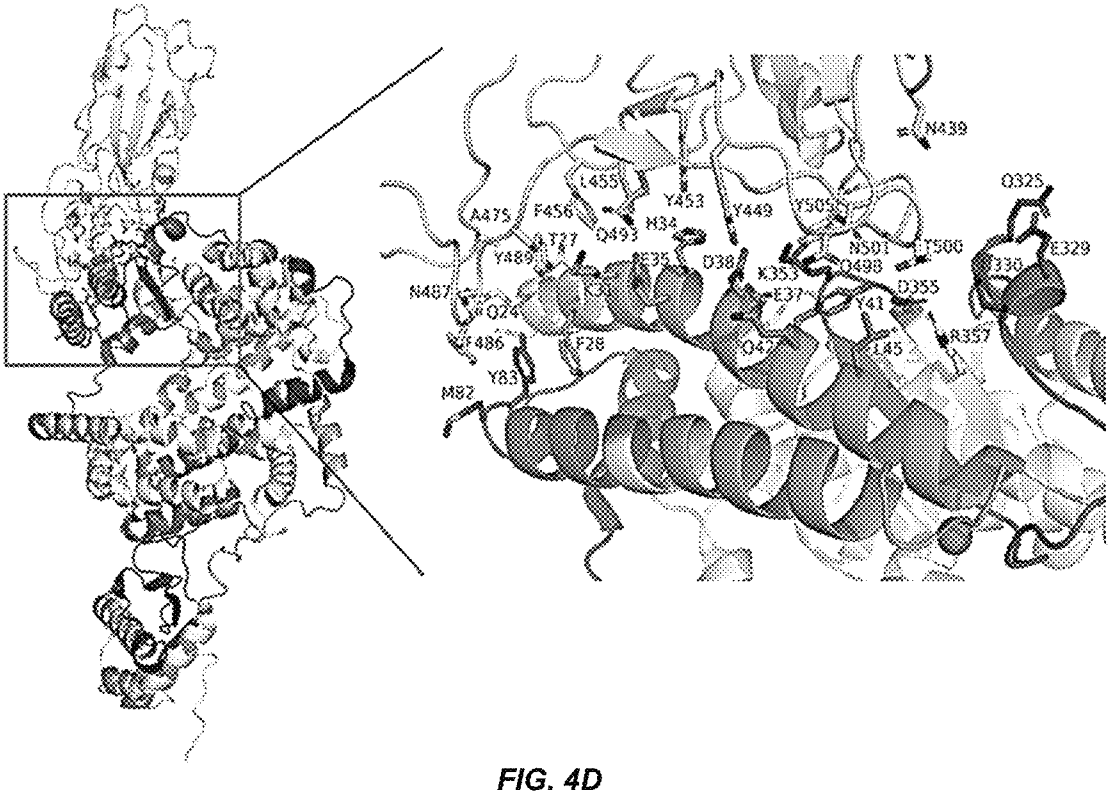

A library of peptides derived from known receptors (and their homologs) of Betacoronaviruses was generated. This screen interrogated 15 proteins, via 11,277 peptide coding gene fragments (FIG. 8B). To express peptides on the cell surface, these were fused to an immunoglobulin K-chain leader sequence at their N terminus and a platelet-derived growth factor (PDGF) transmembrane domain at their C terminus (FIG. 4A-B, 8A). NIH/3T3 cells were used for the screens based on their non-human origin and non-transducability by SARS-CoV-2-Spike protein pseudotyped lentiviruses. Specifically, cells were transduced with the cell-surface peptide library and probed with the SARS-CoV-2 spike protein and RBD domain (bearing a mouse-Fc tag). Cells interacting with the SARS-CoV-2 proteins were separated from the pool using anti-mouse IgG magnetic beads, and their expressed peptides identified via next generation sequencing of the integrated library elements. Binding peptides were identified by comparing the relative abundance of each peptide construct in the bound fraction of cells to the abundance in the starting pool of transduced cells. Several peptides derived from the known SARS-CoV-2 receptor ACE2 were highly enriched across multiple biological replicates, including across two independent SARS-CoV-2 Spike/RBD protein samples (FIG. 4C-D). In addition to peptides derived from known binding proteins such as ACE2 and TMPRSS2, several proteins such as FAP, DPP4, and DPP8 also contained highly significant hits, highlighting putative novel interacting partners of the viral spike protein. Interestingly, the scavenger receptor cysteine rich domain of TMPRSS2 contained a region of peptides which was significantly enriched after selection for spike/RBD binders, illuminating a potential domain implicated in TMPRSS2 substrate recognition.

Figure 4E:
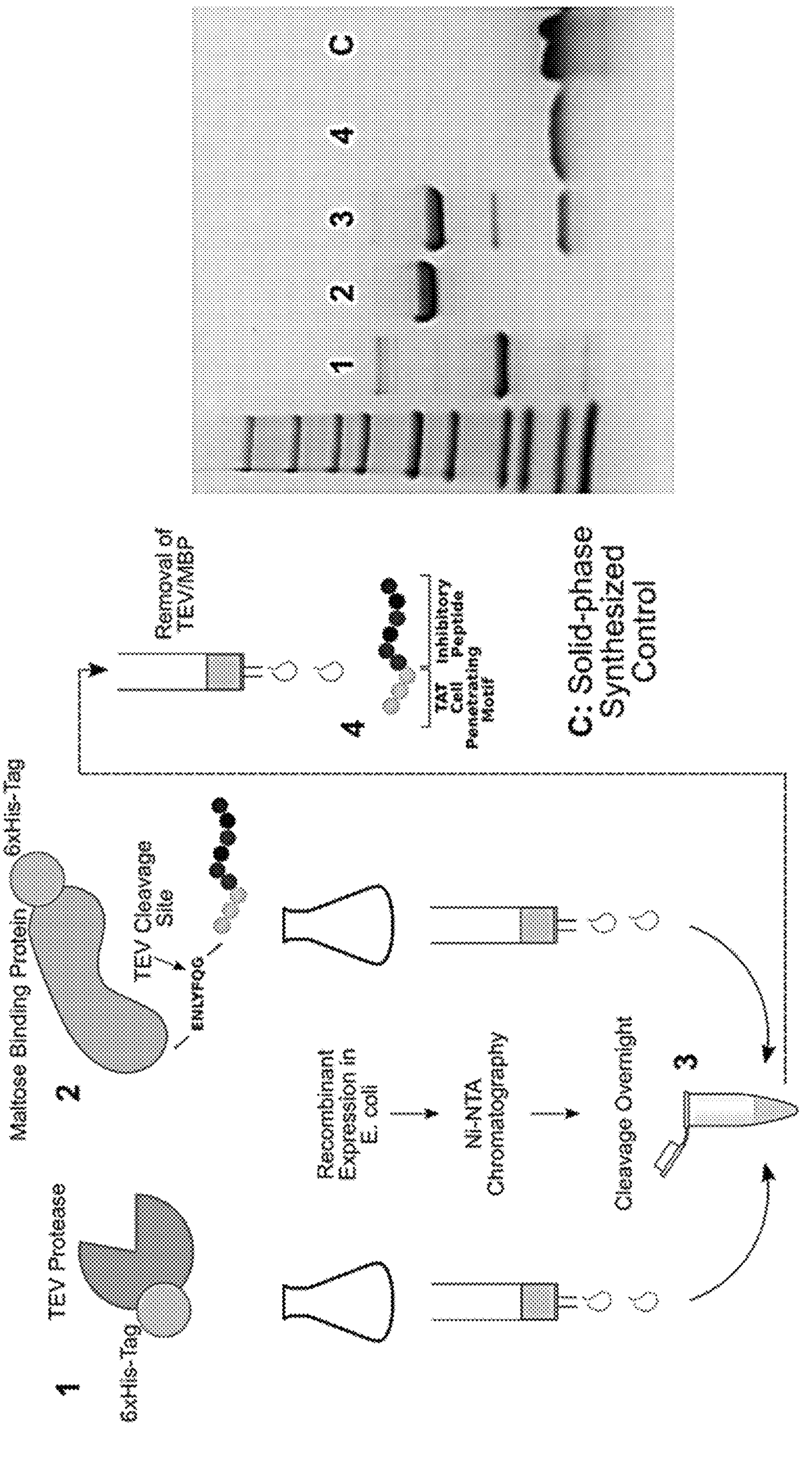
Figure 5A:
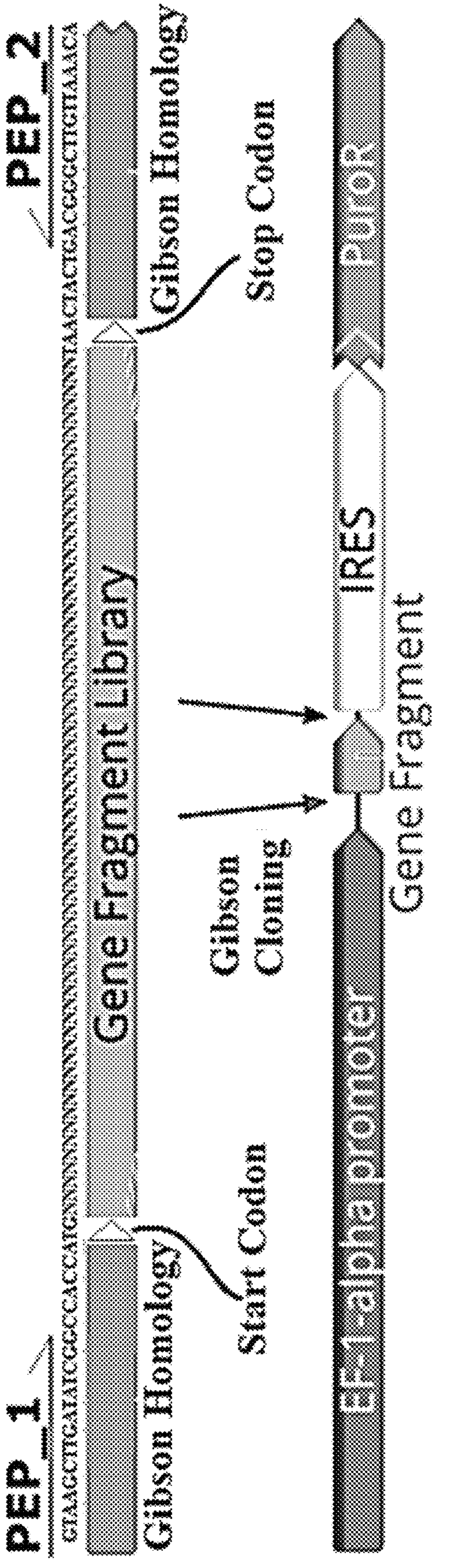
FIG. 5A-E shows a cloning strategy and pilot screen overall analyses: (A) Overview of library construction. Library was ordered as single stranded DNA oligos from Custom Array, and subsequently amplified via PCR to generate gene fragment libraries compatible with Gibson assembly cloning (depicted is SEQ ID NO: 9719). This library was then cloned into pEPIP, with library coverage determined via high throughput sequencing. (B-C) Initial analysis for pooled pilot screen in Hs578T and MDA-MB-231 cells. The majority of peptides tested did not drop out during the fitness screen, although the distribution of peptide log fold change values is skewed towards depletion rather than enrichment. (D-E) The computed fitness scores for the amino acid positions showed good correlation between replicates in both Hs578T and MDA-MB-231. (r=. 536 and r=. 753 respectively). The majority of amino acid positions scored have no significant depletion, with a small subset having a detectable impact on fitness.
Figure 5B:
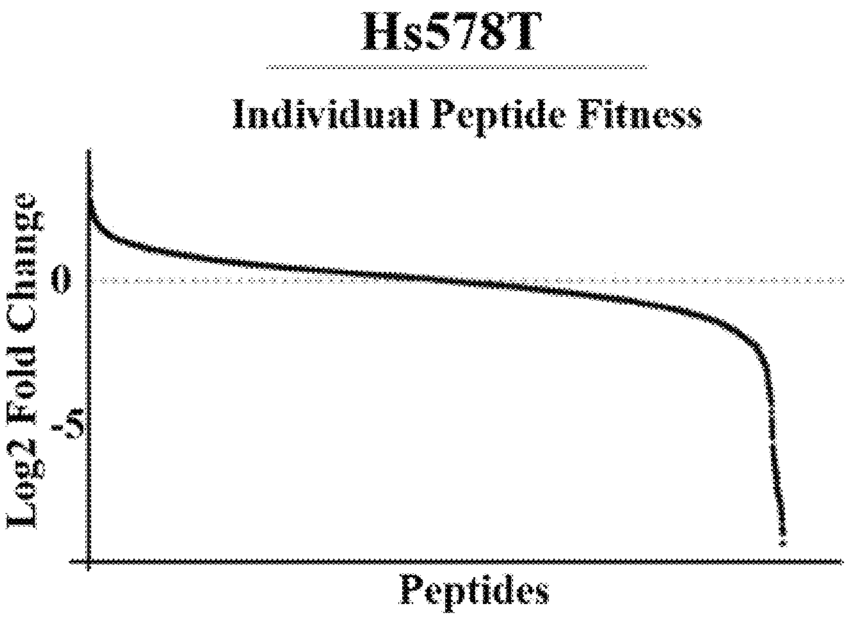
Figure 5C:
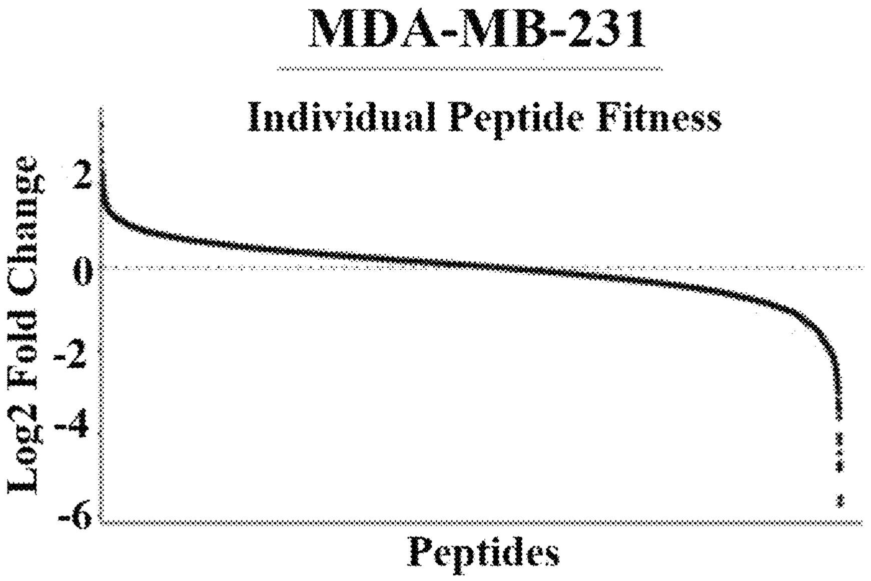
Figure 5D:
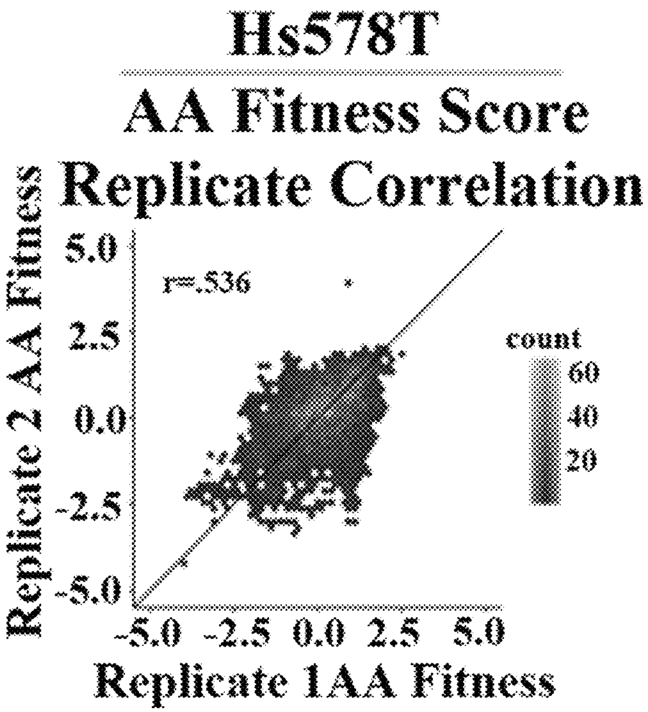
Figure 5E:
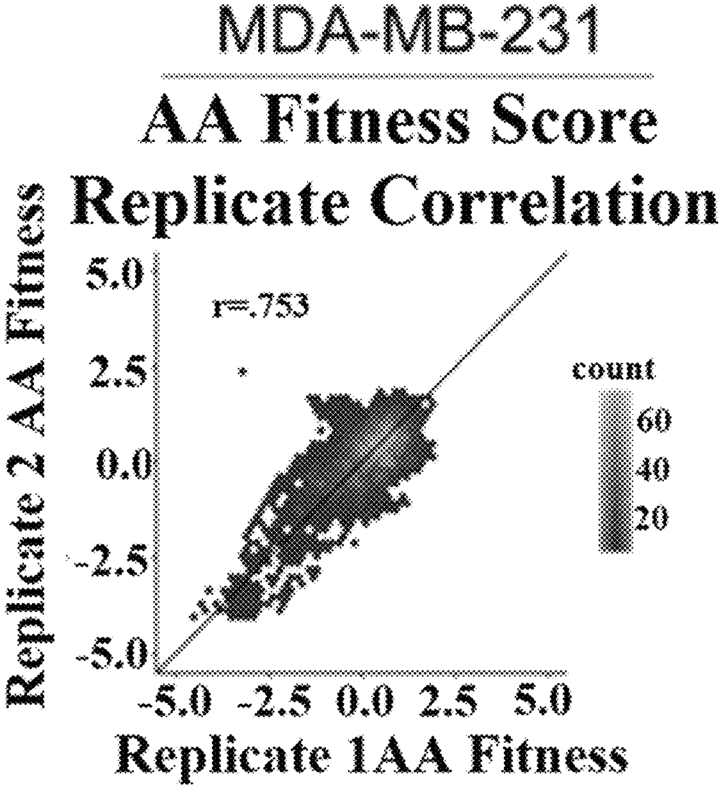

A streamlined peptide purification protocol was developed to facilitate rapid engineering and testing of peptide constructs for translation to medical applications. Specifically, by fusing peptides of interest to a high expressing Maltose Binding Protein (MBP) construct, peptides could be produced in a modular fashion at high yields. By incubating the peptide fusions with TEV protease to cleave the MBP, homogenous preparations of peptide constructs could be produced after subsequent immobilized metal affinity chromatography (IMAC) to remove the free MBP and TEV70. This method was validated by the production of milligram scale quantities of TAT conjugated 3×FLAG peptide, outperforming the costs associated with commercial peptide synthesis (FIG. 4E). Because this method requires no expensive equipment or specialized reagents, it is easily adaptable to labs of any scale, as well as automated medium throughput screening approaches. As peptide constructs will likely require additional engineering to maximize efficacy towards intracellular targets in vivo, this production protocol serves as both a complement to the presented PepTile screening method, as well as a general resource to accelerate the engineering of peptide therapeutics.

Cell Proliferation Assay. The Tat-RAF1-73, Tat-RAF1-78, Tat-EGFR-697 and Tat-Flag peptides were tested for growth inhibition in an in vitro cell proliferation assay. The assay tested the peptides against ten tumor cell lines and four non-tumor cell lines (Primary Fibroblasts, CCD 841 CoN, human umbilical vein cells and Human Hepatocytes). Cells were plated in a 384 well plate and allowed to grow for 24 hrs. Peptides were then added to cultures at a final concentration range of 100 μM-0.2 μM. Cells and peptides were then reacted for 72 hrs, after which the CellTiter-Glo Luminescent Cell Viability Assay kit (Promega) was used to assess cytotoxicity of therapeutic peptides. IC50 values were determined by the percent cell growth of the untreated (vehicle) control calculated from the luminescence signals compared to test wells. The surviving fraction of cells is determined by dividing the mean luminescence values of the test agents by the mean luminescence values of the untreated control. The inhibitory concentration value, IC50, for the test agents and control was estimated using Prism 8 software (GraphPad Software, Inc.) by curve-fitting the data using the non-linear regression analysis.

The results of the cell proliferation assay can be seen in Table 8. Ten cancer cell lines were screened as well as three non-cancer cell types (e.g. primary fibroblasts, CCD 841 CoN, and human hepatocytes). Activity of peptides was identified throughout the cell types including the cancer and non-cancer cell lines. Tat-Raf1-73 and Tat-Raf1-78 had more robust killing, with $IC_{50}$ values ranging from 1.66 μM to 48.87 μM, with Tat-EGFR-697 having more moderate IC50s that ranged from 5 μM to >100 μM (no effect). There was no activity observed in the control Tat-Flag tagged peptides in any of the cells screened.

TABLE 8

| Cell Line | Tissue Type | Mean $IC_{50}$ (μM) Tat-RAF1-73 | Mean $IC_{50}$ (μM) Tat-RAF1-78 | Mean $IC_{50}$ (μM) Tat-EGFR-697 | Mean $IC_{50}$ (μM) Tat-Flag |
|---|---|---|---|---|---|
| H929 | Human Multiple Myeloma | 1.67 | 2.6 | 5.1 | >100 |
| SNU398 | RAF1 mRNA (Log2) 6.07 | 7.91 | 11.06 | 29.23 | >100 |
| Jurkat | RAF1 mRNA (Log2) 6.05 | 7.4 | 9.24 | 41.06 | >100 |
| HUH6-luc | RAF1 mRNA (Log2) 6.05 | 21.31 | 25.32 | 73.48 | >100 |
| Colo205 | Human Colon | 6.12 | 7.28 | 19.81 | >100 |
| A549 | RAF1 mRNA (Log2) Negative | 13.09 | 15.74 | 59.65 | >100 |
| MDA-MB-231 | EGFR mRNA (Log2) 4.78 | 15.5 | 16.13 | 56.62 | >100 |
| HT1376 | EGFR mRNA (Log2) 5. | 25.09 | 26.99 | 95.60* | >100 |
| FaDu | EGFR mRNA (Log2) 6.28 | 20.62 | 26.67 | 89.21 | >100 |
| SK-MEL-5 | EGFR mRNA (Log2) 5.92 | 4.98 | 5.98 | 27.56 | >100 |
| Primary Fibroblasts | Skin Fibroblast | 1.77 | 2.97 | 15.07 | >100 |
| CCD 841 CoN | Normal Human Colon | 40.14 | 48.87 | >100 | >100 |
| Human Hepatocytes | Human Hepatocytes | 4.56 | 6.77 | 11.56 | >100 |
| Human umbilical vein endothelial cells (HUVEC) | Normal endothelial | 4.24 | 4.84 | 14.04 | >100 |

*Value was averaged using >100 μM value for one trial result

It will be understood that various modifications may be made without departing from the spirit and scope of this disclosure. Accordingly, other embodiments are within the scope of the following claims.

SEQUENCE LISTING (9720 sequences)

SEQ ID NO: 1 - protein, 40 aa, Artificial Sequence
  Description of Artificial Sequence: Synthetic polypeptide
IVKEGWLHKRGKYIKTWRPRYFLLKNDGTFIGYKERPQDV

SEQ ID NO: 2 - protein, 40 aa, Artificial Sequence
  Description of Artificial Sequence: Synthetic polypeptide
GWLHKRGKYIKTWRPRYFLLKNDGTFIGYKERPQDVDQRE

SEQ ID NO: 3 - protein, 40 aa, Artificial Sequence
  Description of Artificial Sequence: Synthetic polypeptide
KRGEYIKTWRPRYFLLKNDGTFIGYKERPQDVDQREAPRN

SEQ ID NO: 4 - protein, 40 aa, Artificial Sequence
  Description of Artificial Sequence: Synthetic polypeptide
RGEYIKTWRPRYFLLKNDGTFIGYKERPQDVDQREAPRNN

SEQ ID NO: 5 - protein, 40 aa, Artificial Sequence
  Description of Artificial Sequence: Synthetic polypeptide
PRNNFSVAQCQLMKTERPRPNTFIIRCLQWTTVIERTFHV

SEQ ID NO: 6 - protein, 40 aa, Artificial Sequence
  Description of Artificial Sequence: Synthetic polypeptide
GQITVGQRIVSGSFGTVYKGKWHGDVAVKMLNVTAPTPQQ

SEQ ID NO: 7 - protein, 40 aa, Artificial Sequence
  Description of Artificial Sequence: Synthetic polypeptide
QITVGQRIVSGSFGTVYKGKWHGDVAVKMLNVTAPTPQQL

SEQ ID NO: 8 - protein, 40 aa, Artificial Sequence
  Description of Artificial Sequence: Synthetic polypeptide
QRIGSESFGTVYKGKWHGDVAVKMLNVTAPTPQQLQAFKN

SEQ ID NO: 9 - protein, 40 aa, Artificial Sequence
  Description of Artificial Sequence: Synthetic polypeptide
TVGQRIGSGSCGTVYKGKWHGDVAVKMLNVTAPTPQQLQA

SEQ ID NO: 10 - protein, 40 aa, Artificial Sequence
  Description of Artificial Sequence: Synthetic polypeptide
AKSIIHRDLKSNNIFLHEDLTVKIGGFGLATVKSRWSGSH

SEQ ID NO: 11 - protein, 40 aa, Artificial Sequence
  Description of Artificial Sequence: Synthetic polypeptide
KSIIHRDLKSNNIFLHEDLTVKIGGFGLATVKSRWSGSHQ

SEQ ID NO: 12 - protein, 40 aa, Artificial Sequence
  Description of Artificial Sequence: Synthetic polypeptide
LHAKSIIHRDLKSNNIFLHEDLTVKIGNFGLATVKSRWSG

SEQ ID NO: 13 - protein, 40 aa, Artificial Sequence
  Description of Artificial Sequence: Synthetic polypeptide
HAKSIIHRDLKSNNIFLHEDLTVKIGNFGLATVKSRWSGS

SEQ ID NO: 14 - protein, 40 aa, Artificial Sequence
  Description of Artificial Sequence: Synthetic polypeptide
AKSIIHRDLKSNNIFLHEDLTVKIGNFGLATVKSRWSGSH

SEQ ID NO: 15 - protein, 40 aa, Artificial Sequence
  Description of Artificial Sequence: Synthetic polypeptide
KSIIHRDLKSNNIFLHEDLTVKIGNFGLATVKSRWSGSHQ

SEQ ID NO: 16 - protein, 40 aa, Artificial Sequence
  Description of Artificial Sequence: Synthetic polypeptide
SGGPQALVNIMRTYTFEKLLWTTSRVLKVLSVCSSNKPAI

SEQ ID NO: 17 - protein, 40 aa, Artificial Sequence
  Description of Artificial Sequence: Synthetic polypeptide
AYGNQESKLIILASGGPQALVNIMRTYTYKKLLWTTSRVL

SEQ ID NO: 18 - protein, 40 aa, Artificial Sequence
  Description of Artificial Sequence: Synthetic polypeptide
GNQESKLIILASGGPQALVNIMRTYTYKKLLWTTSRVLKV

SEQ ID NO: 19 - protein, 40 aa, Artificial Sequence
  Description of Artificial Sequence: Synthetic polypeptide
ESKLIILASGGPQALVNIMRTYTYKKLLWTTSRVLKVLSV

SEQ ID NO: 20 - protein, 40 aa, Artificial Sequence
  Description of Artificial Sequence: Synthetic polypeptide
ILASGGPQALVNIMRTYTYKKLLWTTSRVLKVLSVCSSNK

SEQ ID NO: 21 - protein, 40 aa, Artificial Sequence
  Description of Artificial Sequence: Synthetic polypeptide
SGGPQALVNIMRTYTYKKLLWTTSRVLKVLSVCSSNKPAI

SEQ ID NO: 22 - protein, 40 aa, Artificial Sequence
  Description of Artificial Sequence: Synthetic polypeptide
GGPQALVNIMRTYTYKKLLWTTSRVLKVLSVCSSNKPAIV

SEQ ID NO: 23 - protein, 40 aa, Artificial Sequence
  Description of Artificial Sequence: Synthetic polypeptide
PQALVNIMRTYTYKKLLWTTSRVLKVLSVCSSNKPAIVEA

SEQ ID NO: 24 - protein, 40 aa, Artificial Sequence
  Description of Artificial Sequence: Synthetic polypeptide
QALVNIMRTYTYKKLLWTTSRVLKVLSVCSSNKPAIVEAG

SEQ ID NO: 25 - protein, 40 aa, Artificial Sequence
  Description of Artificial Sequence: Synthetic polypeptide
ALVNIMRTYTYKKLLWTTSRVLKVLSVCSSNKPAIVEAGG

SEQ ID NO: 26 - protein, 40 aa, Artificial Sequence
  Description of Artificial Sequence: Synthetic polypeptide
LVNIMRTYTYKKLLWTTSRVLKVLSVCSSNKPAIVEAGGM

SEQ ID NO: 27 - protein, 40 aa, Artificial Sequence
  Description of Artificial Sequence: Synthetic polypeptide
VNIMRTYTYKKLLWTTSRVLKVLSVCSSNKPAIVEAGGMQ

SEQ ID NO: 28 - protein, 40 aa, Artificial Sequence
  Description of Artificial Sequence: Synthetic polypeptide
FENFEKKINYRFKNKAYLLQAFTHASYHYNTITDCYQRLK

SEQ ID NO: 29 - protein, 40 aa, Artificial Sequence
  Description of Artificial Sequence: Synthetic polypeptide
ENFEKKINYRFKNKAYLLQAFTHASYHYNTITDCYQRLKF

SEQ ID NO: 30 - protein, 40 aa, Artificial Sequence
  Description of Artificial Sequence: Synthetic polypeptide
NFEKKINYRFKNKAYLLQAFTHASYHYNTITDCYQRLKFL

SEQ ID NO: 31 - protein, 40 aa, Artificial Sequence
  Description of Artificial Sequence: Synthetic polypeptide
EKKINYRFKNKAYLLQAFTHASYHYNTITDCYQRLKFLGD

SEQ ID NO: 32 - protein, 40 aa, Artificial Sequence
  Description of Artificial Sequence: Synthetic polypeptide
EKKINYRFKNKAYLLQAFTHASYHYNTITDCYQRLEFLGN

SEQ ID NO: 33 - protein, 40 aa, Artificial Sequence
  Description of Artificial Sequence: Synthetic polypeptide
QALLRILKETEFKKIKVLCSGAFGTVYKGLWIPEGEKVKI

SEQ ID NO: 34 - protein, 40 aa, Artificial Sequence
  Description of Artificial Sequence: Synthetic polypeptide
RILKETEFKKIKVLCSGAFGTVYKGLWIPEGEKVKIPVAI

SEQ ID NO: 35 - protein, 40 aa, Artificial Sequence
  Description of Artificial Sequence: Synthetic polypeptide
FKKIKVLCSGAFGTVYKGLWIPEGEKVKIPVAIKELREAT

SEQ ID NO: 36 - protein, 40 aa, Artificial Sequence
  Description of Artificial Sequence: Synthetic polypeptide
KKIKVLCSGAFGTVYKGLWIPEGEKVKIPVAIKELREATS

SEQ ID NO: 37 - protein, 40 aa, Artificial Sequence
  Description of Artificial Sequence: Synthetic polypeptide
NQALLRILKETEFKKIKVLDSGAFGTVYKGLWIPEGEKVK

SEQ ID NO: 38 - protein, 40 aa, Artificial Sequence
  Description of Artificial Sequence: Synthetic polypeptide
QALLRILKETEFKKIKVLDSGAFGTVYKGLWIPEGEKVKI

SEQ ID NO: 39 - protein, 40 aa, Artificial Sequence
  Description of Artificial Sequence: Synthetic polypeptide
RILKETEFKKIKVLDSGAFGTVYKGLWIPEGEKVKIPVAI

SEQ ID NO: 40 - protein, 40 aa, Artificial Sequence
  Description of Artificial Sequence: Synthetic polypeptide
APNQALLRILKETEFKKIKVLGSGAFSTVYKGLWIPEGEK

SEQ ID NO: 41 - protein, 40 aa, Artificial Sequence
  Description of Artificial Sequence: Synthetic polypeptide
PNQALLRILKETEFKKIKVLGSGAFSTVYKGLWIPEGEKV

SEQ ID NO: 42 - protein, 40 aa, Artificial Sequence
  Description of Artificial Sequence: Synthetic polypeptide
NQALLRILKETEFKKIKVLGSGAFSTVYKGLWIPEGEKVK

SEQ ID NO: 43 - protein, 40 aa, Artificial Sequence
  Description of Artificial Sequence: Synthetic polypeptide
QALLRILKETEFKKIKVLGSGAFSTVYKGLWIPEGEKVKI

SEQ ID NO: 44 - protein, 40 aa, Artificial Sequence
  Description of Artificial Sequence: Synthetic polypeptide
LLRILKETEFKKIKVLGSGAFSTVYKGLWIPEGEKVKIPV

SEQ ID NO: 45 - protein, 40 aa, Artificial Sequence
  Description of Artificial Sequence: Synthetic polypeptide
ILKETEFKKIKVLGSGAFSTVYKGLWIPEGEKVKIPVAIK

SEQ ID NO: 46 - protein, 40 aa, Artificial Sequence
  Description of Artificial Sequence: Synthetic polypeptide
LKETEFKKIKVLGSGAFSTVYKGLWIPEGEKVKIPVAIKE

SEQ ID NO: 47 - protein, 40 aa, Artificial Sequence
  Description of Artificial Sequence: Synthetic polypeptide
KETEFKKIKVLGSGAFSTVYKGLWIPEGEKVKIPVAIKEL

SEQ ID NO: 48 - protein, 40 aa, Artificial Sequence
  Description of Artificial Sequence: Synthetic polypeptide
ETEFKKIKVLGSGAFSTVYKGLWIPEGEKVKIPVAIKELR

SEQ ID NO: 49 - protein, 40 aa, Artificial Sequence
  Description of Artificial Sequence: Synthetic polypeptide
KVLGSGAFSTVYKGLWIPEGEKVKIPVAIKELREATSPKA

SEQ ID NO: 50 - protein, 40 aa, Artificial Sequence
  Description of Artificial Sequence: Synthetic polypeptide
PPNQRRVYISYPDSVHFFRPKCLRTAVYHEILIGYLEYVK

SEQ ID NO: 51 - protein, 40 aa, Artificial Sequence
  Description of Artificial Sequence: Synthetic polypeptide
PNQRRVYISYPDSVHFFRPKCLRTAVYHEILIGYLEYVKK

SEQ ID NO: 52 - protein, 40 aa, Artificial Sequence
  Description of Artificial Sequence: Synthetic polypeptide
NQRRVYISYPDSVHFFRPKCLRTAVYHEILIGYLEYVKKL

SEQ ID NO: 53 - protein, 40 aa, Artificial Sequence
  Description of Artificial Sequence: Synthetic polypeptide
RVYISYPDSVHFFRPKCLRTAVYHEILIGYLEYVKKLGYT

SEQ ID NO: 54 - protein, 40 aa, Artificial Sequence
  Description of Artificial Sequence: Synthetic polypeptide
PPPNQRRVYISYLNSVHFFRPKCLRTAVYHEILIGYLEYV

SEQ ID NO: 55 - protein, 40 aa, Artificial Sequence
  Description of Artificial Sequence: Synthetic polypeptide
PPNQRRVYISYLNSVHFFRPKCLRTAVYHEILIGYLEYVK

SEQ ID NO: 56 - protein, 40 aa, Artificial Sequence
  Description of Artificial Sequence: Synthetic polypeptide
YLNSVHFFRPKCLRTAVYHEILIGYLEYVKKLGYTTGHIW

SEQ ID NO: 57 - protein, 40 aa, Artificial Sequence
  Description of Artificial Sequence: Synthetic polypeptide
RVYISYLDIVHFFRPKCLRTAVYHEILIGYLEYVKKLGYT

SEQ ID NO: 58 - protein, 40 aa, Artificial Sequence
  Description of Artificial Sequence: Synthetic polypeptide
RRVYISYLDSVHFFRPKCLRTAVDHEILIGYLEYVKKLGY

SEQ ID NO: 59 - protein, 40 aa, Artificial Sequence
  Description of Artificial Sequence: Synthetic polypeptide
PPPDQKIPKPKRLQEWYKKMLDKAVSERIVHDYKDIFKQA

SEQ ID NO: 60 - protein, 40 aa, Artificial Sequence
  Description of Artificial Sequence: Synthetic polypeptide
ETELRKVKVLGSGAFGTVYKGIWIPDGENVKIPVAIKVSR

SEQ ID NO: 61 - protein, 40 aa, Artificial Sequence
  Description of Artificial Sequence: Synthetic polypeptide
ARRINDEIERQLRRDKRDARRELKLLLLGTVESGKSTFIK

SEQ ID NO: 62 - protein, 40 aa, Artificial Sequence
  Description of Artificial Sequence: Synthetic polypeptide
IERQLRRDKRDARRELKLLLLGTVESGKSTFIKQMRIIHG

SEQ ID NO: 63 - protein, 40 aa, Artificial Sequence
  Description of Artificial Sequence: Synthetic polypeptide
QLRRDKRDARRELKLLLLGTVESGKSTFIKQMRIIHGSGY

SEQ ID NO: 64 - protein, 40 aa, Artificial Sequence
  Description of Artificial Sequence: Synthetic polypeptide
MQTLLSLVRQYNPKMVKVASLLVKRTPRSVGYKPDFVGFE

SEQ ID NO: 65 - protein, 40 aa, Artificial Sequence
  Description of Artificial Sequence: Synthetic polypeptide
QTLLSLVRQYNPKMVKVASLLVKRTPRSVGYKPDFVGFEI

SEQ ID NO: 66 - protein, 40 aa, Artificial Sequence
  Description of Artificial Sequence: Synthetic polypeptide
KSPNETIRNILGGTVFREPIICKNIPRLVPGWTKPITIGR

SEQ ID NO: 67 - protein, 40 aa, Artificial Sequence
  Description of Artificial Sequence: Synthetic polypeptide
VEEFKLKKMWKSPNGTIQNILGGTVFREPIICKNIPRLVP

SEQ ID NO: 68 - protein, 40 aa, Artificial Sequence
  Description of Artificial Sequence: Synthetic polypeptide
NILGGTVFREPIICKNIPRLVPGWTKPITIGGHAHGDQYK

SEQ ID NO: 69 - protein, 40 aa, Artificial Sequence
  Description of Artificial Sequence: Synthetic polypeptide
SPNGTIRNILGGTVFREPIICKNIPRLVPGWTKPITIGSH

SEQ ID NO: 70 - protein, 40 aa, Artificial Sequence
  Description of Artificial Sequence: Synthetic polypeptide
MAFLASKNCIHRDLAARNILLTHGRITKICDFVLARDIKN

SEQ ID NO: 71 - protein, 40 aa, Artificial Sequence
  Description of Artificial Sequence: Synthetic polypeptide
RNILLTHGRITKICDFVLARDIKNDSNYVVKGNARLPVKW

SEQ ID NO: 72 - protein, 40 aa, Artificial Sequence
  Description of Artificial Sequence: Synthetic polypeptide
CIHRDLAARNILLTHGRITKICDFGLARVIKNDSNYVVKG

SEQ ID NO: 73 - protein, 40 aa, Artificial Sequence
  Description of Artificial Sequence: Synthetic polypeptide
HGRITKICDFGLARVIKNDSNYVVKGNARLPVKWMAPESI

SEQ ID NO: 74 - protein, 40 aa, Artificial Sequence
  Description of Artificial Sequence: Synthetic polypeptide
HKPSGLVMARKLIHLEIKPAIRNQIIRELQVLHECNSLYI

SEQ ID NO: 75 - protein, 40 aa, Artificial Sequence
  Description of Artificial Sequence: Synthetic polypeptide
GLARDMYDKEYYSVHNKTGAKLHVKWMALESLQTQKFTTK

SEQ ID NO: 76 - protein, 40 aa, Artificial Sequence
  Description of Artificial Sequence: Synthetic polypeptide
LIHQLLTDIGRYHPQALIYPLRVASKSTTTARHNAANKIL

SEQ ID NO: 77 - protein, 40 aa, Artificial Sequence
  Description of Artificial Sequence: Synthetic polypeptide
IQRYAVIPVSTNSGLIGWVPHCDTLHALIRDYREKKKILL

SEQ ID NO: 78 - protein, 40 aa, Artificial Sequence
  Description of Artificial Sequence: Synthetic polypeptide
PSYSRRISTATPYMNGETSTKSLWVINSALRIKILCATYG

SEQ ID NO: 79 - protein, 40 aa, Artificial Sequence
  Description of Artificial Sequence: Synthetic polypeptide
SRRISTATPYMNGETSTKSLWVINSALRIKILCATYGNVN

SEQ ID NO: 80 - protein, 40 aa, Artificial Sequence
  Description of Artificial Sequence: Synthetic polypeptide
STKSLWVINSALRIKILCATYGNVNIRDIDKIYVRTGIYH

SEQ ID NO: 81 - protein, 40 aa, Artificial Sequence
  Description of Artificial Sequence: Synthetic polypeptide
SYSRRISTATPYMNGETSTKSLWVINSALRIKILCATYMN

SEQ ID NO: 82 - protein, 40 aa, Artificial Sequence
  Description of Artificial Sequence: Synthetic polypeptide
SRRISTATPYMNGETSTKSLWVINSALRIKILCATYMNVN

SEQ ID NO: 83 - protein, 40 aa, Artificial Sequence
  Description of Artificial Sequence: Synthetic polypeptide
RISTATPYMNGETSTKSLWVINSALRIKILCATYMNVNIR

SEQ ID NO: 84 - protein, 40 aa, Artificial Sequence
  Description of Artificial Sequence: Synthetic polypeptide
TSTKSLWVINSALRIKILCATYMNVNIRDIDKIYVRTGIY

SEQ ID NO: 85 - protein, 40 aa, Artificial Sequence
  Description of Artificial Sequence: Synthetic polypeptide
STKSLWVINSALRIKILCATYMNVNIRDIDKIYVRTGIYH

SEQ ID NO: 86 - protein, 40 aa, Artificial Sequence
  Description of Artificial Sequence: Synthetic polypeptide
TKSLWVINSALRIKILCATYMNVNIRDIDKIYVRTGIYHG

SEQ ID NO: 87 - protein, 40 aa, Artificial Sequence
  Description of Artificial Sequence: Synthetic polypeptide
YSRRISTATPYMNGETSTKSLWVINSALRIKILCATYVIV

SEQ ID NO: 88 - protein, 40 aa, Artificial Sequence
  Description of Artificial Sequence: Synthetic polypeptide
SRRISTATPYMNGETSTKSLWVINSALRIKILCATYVIVN

SEQ ID NO: 89 - protein, 40 aa, Artificial Sequence
  Description of Artificial Sequence: Synthetic polypeptide
RRISTATPYMNGETSTKSLWVINSALRIKILCATYVIVNI

SEQ ID NO: 90 - protein, 40 aa, Artificial Sequence
  Description of Artificial Sequence: Synthetic polypeptide
TSTKSLWVINSALRIKILCATYVIVNIRDIDKIYVRTGIY

SEQ ID NO: 91 - protein, 40 aa, Artificial Sequence
  Description of Artificial Sequence: Synthetic polypeptide
STKSLWVINSALRIKILCATYVIVNIRDIDKIYVRTGIYH

SEQ ID NO: 92 - protein, 40 aa, Artificial Sequence
  Description of Artificial Sequence: Synthetic polypeptide
YSRRISTATPYMNGETSTKSLWVINSALRIKILCATYVYV

SEQ ID NO: 93 - protein, 40 aa, Artificial Sequence
  Description of Artificial Sequence: Synthetic polypeptide
SRRISTATPYMNGETSTKSLWVINSALRIKILCATYVYVN

SEQ ID NO: 94 - protein, 40 aa, Artificial Sequence
  Description of Artificial Sequence: Synthetic polypeptide
RRISTATPYMNGETSTKSLWVINSALRIKILCATYVYVNI

SEQ ID NO: 95 - protein, 40 aa, Artificial Sequence
  Description of Artificial Sequence: Synthetic polypeptide
RISTATPYMNGETSTKSLWVINSALRIKILCATYVYVNIR

SEQ ID NO: 96 - protein, 40 aa, Artificial Sequence
  Description of Artificial Sequence: Synthetic polypeptide
TSTKSLWVINSALRIKILCATYVYVNIRDIDKIYVRTGIY

SEQ ID NO: 97 - protein, 40 aa, Artificial Sequence
  Description of Artificial Sequence: Synthetic polypeptide
STKSLWVINSALRIKILCATYVYVNIRDIDKIYVRTGIYH

SEQ ID NO: 98 - protein, 40 aa, Artificial Sequence
  Description of Artificial Sequence: Synthetic polypeptide
WVINSALRIKILCATYVNVNIRDIDKIYVRTGIYHGGVPL

SEQ ID NO: 99 - protein, 40 aa, Artificial Sequence
  Description of Artificial Sequence: Synthetic polypeptide
GQLFHIDFGHFLDHKKKKFGYKRERVPFVFTQDFLIVISK

SEQ ID NO: 100 - protein, 40 aa, Artificial Sequence
  Description of Artificial Sequence: Synthetic polypeptide
QLFHIDFGHFLDHKKKKFGYKRERVPFVFTQDFLIVISKG

SEQ ID NO: 101 - protein, 40 aa, Artificial Sequence
  Description of Artificial Sequence: Synthetic polypeptide
LFHIDFGHFLDHKKKKFGYKRERVPFVFTQDFLIVISKGA

SEQ ID NO: 102 - protein, 40 aa, Artificial Sequence
  Description of Artificial Sequence: Synthetic polypeptide
FHIDFGHFLDHKKKKFGYKRERVPFVFTQDFLIVISKGAQ

SEQ ID NO: 103 - protein, 40 aa, Artificial Sequence
  Description of Artificial Sequence: Synthetic polypeptide
HIDFGHFLDHKKKKFGYKRERVPFVFTQDFLIVISKGAQE

SEQ ID NO: 104 - protein, 40 aa, Artificial Sequence
  Description of Artificial Sequence: Synthetic polypeptide
IDFGHFLDHKKKKFGYKRERVPFVFTQDFLIVISKGAQEC

SEQ ID NO: 105 - protein, 40 aa, Artificial Sequence
  Description of Artificial Sequence: Synthetic polypeptide
DFGHFLDHKKKKFGYKRERVPFVFTQDFLIVISKGAQECT

SEQ ID NO: 106 - protein, 40 aa, Artificial Sequence
  Description of Artificial Sequence: Synthetic polypeptide
FGHFLDHKKKKFGYKRERVPFVFTQDFLIVISKGAQECTK

SEQ ID NO: 107 - protein, 40 aa, Artificial Sequence
  Description of Artificial Sequence: Synthetic polypeptide
GHFLDHKKKKFGYKRERVPFVFTQDFLIVISKGAQECTKT

SEQ ID NO: 108 - protein, 40 aa, Artificial Sequence
  Description of Artificial Sequence: Synthetic polypeptide
FLDHKKKKFGYKRERVPFVFTQDFLIVISKGAQECTKTRE

SEQ ID NO: 109 - protein, 40 aa, Artificial Sequence
  Description of Artificial Sequence: Synthetic polypeptide
HKKKKFGYKRERVPFVFTQDFLIVISKGAQECTKTREFER

SEQ ID NO: 110 - protein, 40 aa, Artificial Sequence
  Description of Artificial Sequence: Synthetic polypeptide
KKKKFGYKRERVPFVFTQDFLIVISKGAQECTKTREFERF

SEQ ID NO: 111 - protein, 40 aa, Artificial Sequence
  Description of Artificial Sequence: Synthetic polypeptide
KKKFGYKRERVPFVFTQDFLIVISKGAQECTKTREFERFQ

SEQ ID NO: 112 - protein, 40 aa, Artificial Sequence
  Description of Artificial Sequence: Synthetic polypeptide
EKLRDTADGTFLVRDASTKMHGDYTLTLRKWGNNKLIKIF

SEQ ID NO: 113 - protein, 40 aa, Artificial Sequence
  Description of Artificial Sequence: Synthetic polypeptide
RDTADGTFLVRDASTKMHGDYTLTLRKWGNNKLIKIFHRD

SEQ ID NO: 114 - protein, 40 aa, Artificial Sequence
  Description of Artificial Sequence: Synthetic polypeptide
TFLVRDASTKMHGDYTLTLRKWGNNKLIKIFHRDGKYGFS

SEQ ID NO: 115 - protein, 40 aa, Artificial Sequence
  Description of Artificial Sequence: Synthetic polypeptide
VRDASTKMHGDYTLTLRKWGNNKLIKIFHRDGKYGFSDPL

SEQ ID NO: 116 - protein, 40 aa, Artificial Sequence
  Description of Artificial Sequence: Synthetic polypeptide
ASTKMHGDYTLTLRKWGNNKLIKIFHRDGKYGFSDPLTFS

SEQ ID NO: 117 - protein, 40 aa, Artificial Sequence
  Description of Artificial Sequence: Synthetic polypeptide
TKMHGDYTLTLRKWGNNKLIKIFHRDGKYGFSDPLTFSSV

SEQ ID NO: 118 - protein, 40 aa, Artificial Sequence
  Description of Artificial Sequence: Synthetic polypeptide
YTLTLRKWGNNKLIKIFHRDGKYGFSDPLTFSSVVELINH

SEQ ID NO: 119 - protein, 40 aa, Artificial Sequence
  Description of Artificial Sequence: Synthetic polypeptide
TLTLRKWGNNKLIKIFHRDGKYGFSDPLTFSSVVELINHY

SEQ ID NO: 120 - protein, 40 aa, Artificial Sequence
  Description of Artificial Sequence: Synthetic polypeptide
LTLRKWGNNKLIKIFHRDGKYGFSDPLTFSSVVELINHYR

SEQ ID NO: 121 - protein, 40 aa, Artificial Sequence
  Description of Artificial Sequence: Synthetic polypeptide
TLRKWGNNKLIKIFHRDGKYGFSDPLTFSSVVELINHYRN

SEQ ID NO: 122 - protein, 40 aa, Artificial Sequence
  Description of Artificial Sequence: Synthetic polypeptide
RKWGNNKLIKIFHRDGKYGFSDPLTFSSVVELINHYRNES

SEQ ID NO: 123 - protein, 40 aa, Artificial Sequence
  Description of Artificial Sequence: Synthetic polypeptide
EKLRDTADGTFLVRDASTKMHGDYTLTLRKGRNNKLIKIF

SEQ ID NO: 124 - protein, 40 aa, Artificial Sequence
  Description of Artificial Sequence: Synthetic polypeptide
ADGTFLVRDASTKMHGDYTLTLRKGRNNKLIKIFHRDGKY

SEQ ID NO: 125 - protein, 40 aa, Artificial Sequence
  Description of Artificial Sequence: Synthetic polypeptide
DGTFLVRDASTKMHGDYTLTLRKGRNNKLIKIFHRDGKYG

SEQ ID NO: 126 - protein, 40 aa, Artificial Sequence
  Description of Artificial Sequence: Synthetic polypeptide
ASTKMHGDYTLTLRKGRNNKLIKIFHRDGKYGFSDPLTFS

SEQ ID NO: 127 - protein, 40 aa, Artificial Sequence
  Description of Artificial Sequence: Synthetic polypeptide
HGDYTLTLRKGRNNKLIKIFHRDGKYGFSDPLTFSSVVEL

SEQ ID NO: 128 - protein, 40 aa, Artificial Sequence
  Description of Artificial Sequence: Synthetic polypeptide
DYTLTLRKGRNNKLIKIFHRDGKYGFSDPLTFSSVVELIN

SEQ ID NO: 129 - protein, 40 aa, Artificial Sequence
  Description of Artificial Sequence: Synthetic polypeptide
KGRNNKLIKIFHRDGKYGFSDPLTFSSVVELINHYRNESL

SEQ ID NO: 130 - protein, 40 aa, Artificial Sequence
  Description of Artificial Sequence: Synthetic polypeptide
FLVRDASTKMHGDYTLTLRKGGNNNLIKIFHRDGKYGFSD

SEQ ID NO: 131 - protein, 40 aa, Artificial Sequence
  Description of Artificial Sequence: Synthetic polypeptide
VRDASTKMHGDYTLTLRKGGNNNLIKIFHRDGKYGFSDPL

SEQ ID NO: 132 - protein, 40 aa, Artificial Sequence
  Description of Artificial Sequence: Synthetic polypeptide
ASTKMHGDYTLTLRKGGNNNLIKIFHRDGKYGFSDPLTFS

SEQ ID NO: 133 - protein, 40 aa, Artificial Sequence
  Description of Artificial Sequence: Synthetic polypeptide
YPEIDKRMNSIKPDLIQLRKTRDQYLMWLTQKGVRQKKLN

SEQ ID NO: 134 - protein, 40 aa, Artificial Sequence
  Description of Artificial Sequence: Synthetic polypeptide
RIMHNYDKLKSRISEIIDSRRRLEEDLKKQAAEYREIGKR

SEQ ID NO: 135 - protein, 40 aa, Artificial Sequence
  Description of Artificial Sequence: Synthetic polypeptide
IMHNYDKLKSRISEIIDSRRRLEEDLKKQAAEYREIGKRM

SEQ ID NO: 136 - protein, 40 aa, Artificial Sequence
  Description of Artificial Sequence: Synthetic polypeptide
KLKSRISEIIDSRRRLEEDLKKQAAEYREIGKRMNSIKPD

SEQ ID NO: 137 - protein, 40 aa, Artificial Sequence
  Description of Artificial Sequence: Synthetic polypeptide
SEIIDSRRRLEEDLKKQAAEYREIGKRMNSIKPDLIQLRK

SEQ ID NO: 138 - protein, 40 aa, Artificial Sequence
  Description of Artificial Sequence: Synthetic polypeptide
EIIDSRRRLEEDLKKQAAEYREIGKRMNSIKPDLIQLRKT

SEQ ID NO: 139 - protein, 40 aa, Artificial Sequence
  Description of Artificial Sequence: Synthetic polypeptide
IIDSRRRLEEDLKKQAAEYREIGKRMNSIKPDLIQLRKTR

SEQ ID NO: 140 - protein, 40 aa, Artificial Sequence
  Description of Artificial Sequence: Synthetic polypeptide
QRIMHNYDKLKSRISEIIDSRRRLEEDLKKQAAEYREIYK

SEQ ID NO: 141 - protein, 40 aa, Artificial Sequence
  Description of Artificial Sequence: Synthetic polypeptide
RIMHNYDKLKSRISEIIDSRRRLEEDLKKQAAEYREIYKR

SEQ ID NO: 142 - protein, 40 aa, Artificial Sequence
  Description of Artificial Sequence: Synthetic polypeptide
IMHNYDKLKSRISEIIDSRRRLEEDLKKQAAEYREIYKRM

SEQ ID NO: 143 - protein, 40 aa, Artificial Sequence
  Description of Artificial Sequence: Synthetic polypeptide
MHNYDKLKSRISEIIDSRRRLEEDLKKQAAEYREIYKRMN

SEQ ID NO: 144 - protein, 40 aa, Artificial Sequence
  Description of Artificial Sequence: Synthetic polypeptide
NYDKLKSRISEIIDSRRRLEEDLKKQAAEYREIYKRMNSI

SEQ ID NO: 145 - protein, 40 aa, Artificial Sequence
  Description of Artificial Sequence: Synthetic polypeptide
YDKLKSRISEIIDSRRRLEEDLKKQAAEYREIYKRMNSIK

SEQ ID NO: 146 - protein, 40 aa, Artificial Sequence
  Description of Artificial Sequence: Synthetic polypeptide
SRRRLEEDLKKQAAEYREIYKRMNSIKPDLIQLRKTRDQY

SEQ ID NO: 147 - protein, 40 aa, Artificial Sequence
  Description of Artificial Sequence: Synthetic polypeptide
NYDKLKSRISEIIDSRRRLEEDLKKQAAEYREIDKRMNRI

SEQ ID NO: 148 - protein, 40 aa, Artificial Sequence
  Description of Artificial Sequence: Synthetic polypeptide
YDKLKSRISEIIDSRRRLEEDLKKQAAEYREIDKRMNRIK

SEQ ID NO: 149 - protein, 40 aa, Artificial Sequence
  Description of Artificial Sequence: Synthetic polypeptide
SRRRLEEDLKKQAAEYREIDKRMNRIKPDLIQLRKTRDQY

SEQ ID NO: 150 - protein, 40 aa, Artificial Sequence
  Description of Artificial Sequence: Synthetic polypeptide
RRRLEEDLKKQAAEYREIDKRMNRIKPDLIQLRKTRDQYL

SEQ ID NO: 151 - protein, 40 aa, Artificial Sequence
  Description of Artificial Sequence: Synthetic polypeptide
IIDSRRRLEEDLKKQAAEYREIDKRMNSIKTDLIQLRKTR

SEQ ID NO: 152 - protein, 40 aa, Artificial Sequence
  Description of Artificial Sequence: Synthetic polypeptide
SRTSACGLFSVCYPRVSSAVKAELRQYFRNLCSDDTRMVR

SEQ ID NO: 153 - protein, 40 aa, Artificial Sequence
  Description of Artificial Sequence: Synthetic polypeptide
RVSSAVKAELRQYFRNLCSDDTRMVRRAAASKLGEFAKVL

SEQ ID NO: 154 - protein, 40 aa, Artificial Sequence
  Description of Artificial Sequence: Synthetic polypeptide
TLQQQECKLLYSRKEGQRQENKNKNRCKNILPFDHTRVVL

SEQ ID NO: 155 - protein, 40 aa, Artificial Sequence
  Description of Artificial Sequence: Synthetic polypeptide
FETLQQQECKLLYSRKEGQRQENKNKNRYKNMLPFDHTRV

SEQ ID NO: 156 - protein, 40 aa, Artificial Sequence
  Description of Artificial Sequence: Synthetic polypeptide
ETLQQQECKLLYSRKEGQRQENKNKNRYKNMLPFDHTRVV

SEQ ID NO: 157 - protein, 40 aa, Artificial Sequence
  Description of Artificial Sequence: Synthetic polypeptide
TLQQQECKLLYSRKEGQRQENKNKNRYKNMLPFDHTRVVL

SEQ ID NO: 158 - protein, 40 aa, Artificial Sequence
  Description of Artificial Sequence: Synthetic polypeptide
LQQQECKLLYSRKEGQRQENKNKNRYKNMLPFDHTRVVLH

SEQ ID NO: 159 - protein, 40 aa, Artificial Sequence
  Description of Artificial Sequence: Synthetic polypeptide
QQQECKLLYSRKEGQRQENKNKNRYKNMLPFDHTRVVLHD

SEQ ID NO: 160 - protein, 40 aa, Artificial Sequence
  Description of Artificial Sequence: Synthetic polypeptide
QQECKLLYSRKEGQRQENKNKNRYKNMLPFDHTRVVLHDG

SEQ ID NO: 161 - protein, 40 aa, Artificial Sequence
  Description of Artificial Sequence: Synthetic polypeptide
QECKLLYSRKEGQRQENKNKNRYKNMLPFDHTRVVLHDGD

SEQ ID NO: 162 - protein, 40 aa, Artificial Sequence
  Description of Artificial Sequence: Synthetic polypeptide
ECKLLYSRKEGQRQENKNKNRYKNMLPFDHTRVVLHDGDP

SEQ ID NO: 163 - protein, 40 aa, Artificial Sequence
  Description of Artificial Sequence: Synthetic polypeptide
CKLLYSRKEGQRQENKNKNRYKNMLPFDHTRVVLHDGDPN

SEQ ID NO: 164 - protein, 40 aa, Artificial Sequence
  Description of Artificial Sequence: Synthetic polypeptide
KLLYSRKEGQRQENKNKNRYKNMLPFDHTRVVLHDGDPNE

SEQ ID NO: 165 - protein, 40 aa, Artificial Sequence
  Description of Artificial Sequence: Synthetic polypeptide
DVPKTIQMVRSQRSVMVQTEAQYRFIYMAVQHYIETLQRR

SEQ ID NO: 166 - protein, 40 aa, Artificial Sequence
  Description of Artificial Sequence: Synthetic polypeptide
QRSGIVQTEAQYRFIYMAVQHYIETLQRRIEEEQKSKRKG

SEQ ID NO: 167 - protein, 40 aa, Artificial Sequence
  Description of Artificial Sequence: Synthetic polypeptide
VRSQRSGMVQKEAQYRFIYMAVQHYIETLQRRIEEEQKSK

SEQ ID NO: 168 - protein, 40 aa, Artificial Sequence
  Description of Artificial Sequence: Synthetic polypeptide
RSGMVQTEAHYRFIYMAVQHYIETLQRRIEEEQKSKRKGH

SEQ ID NO: 169 - protein, 40 aa, Artificial Sequence
  Description of Artificial Sequence: Synthetic polypeptide
HYRFIYMAVQHYIETLQRRIEEEQKSKRKGHEYTNIKYSL

SEQ ID NO: 170 - protein, 40 aa, Artificial Sequence
  Description of Artificial Sequence: Synthetic polypeptide
RSQRSGMVQTEALYRFIYMAVQHYIETLQRRIEEEQKSKR

SEQ ID NO: 171 - protein, 40 aa, Artificial Sequence
  Description of Artificial Sequence: Synthetic polypeptide
LYRFIYMAVQHYIETLQRRIEEEQKSKRKGHEYTNIKYSL

SEQ ID NO: 172 - protein, 40 aa, Artificial Sequence
  Description of Artificial Sequence: Synthetic polypeptide
AKEIGAVKYLECSVLTQRGLKTVFDEAIRAVLCPPPVKKR

SEQ ID NO: 173 - protein, 40 aa, Artificial Sequence
  Description of Artificial Sequence: Synthetic polypeptide
ANRIGAFGYMECSTKTKDGVREVFEMATRAALQARRGKKK

SEQ ID NO: 174 - protein, 40 aa, Artificial Sequence
  Description of Artificial Sequence: Synthetic polypeptide
AFGYMECSTKTKDGVREVFEMATRAALQARRGKKKSGCLV

SEQ ID NO: 175 - protein, 40 aa, Artificial Sequence
  Description of Artificial Sequence: Synthetic polypeptide
AFGYMECSVKTKDGVREVFEMATRAALQARRGKKKSGCLV

SEQ ID NO: 176 - protein, 40 aa, Artificial Sequence
  Description of Artificial Sequence: Synthetic polypeptide
YCSNRQFQRKQHADVEVILTEKKGWGLRAAKDLPSNTFVL

SEQ ID NO: 177 - protein, 40 aa, Artificial Sequence
  Description of Artificial Sequence: Synthetic polypeptide
LRAAKDLPSNTFVLEYCGEVLDHKEFKARVKEYARNKNIR

SEQ ID NO: 178 - protein, 40 aa, Artificial Sequence
  Description of Artificial Sequence: Synthetic polypeptide
SNTFVLEYCGEVLDHKEFKARVKEYARNKNIRYYFMALKN

SEQ ID NO: 179 - protein, 40 aa, Artificial Sequence
  Description of Artificial Sequence: Synthetic polypeptide
HKEFKARVKEYARNKNIHYYFMALKNDEIIDATQKGNCSL

SEQ ID NO: 180 - protein, 40 aa, Artificial Sequence
  Description of Artificial Sequence: Synthetic polypeptide
DQYVRNTTARAFAVVASALGIPSLLPFLKAVCKSKKSWQA

SEQ ID NO: 181 - protein, 40 aa, Artificial Sequence
  Description of Artificial Sequence: Synthetic polypeptide
EYVRYTTARAFAVVASALGIPSLLPFLKAVCKSKKSWQAR

SEQ ID NO: 182 - protein, 40 aa, Artificial Sequence
  Description of Artificial Sequence: Synthetic polypeptide
YTTARAFAVVASALGIPSLLPFLKAVCKSKKSWQARHTGI

SEQ ID NO: 183 - protein, 40 aa, Artificial Sequence
  Description of Artificial Sequence: Synthetic polypeptide
NTTARAFAVVASALGIPSLLPFLKAVCKSKKSWQARRTGI

SEQ ID NO: 184 - protein, 40 aa, Artificial Sequence
  Description of Artificial Sequence: Synthetic polypeptide
AFAVVASALGIPSLLPFLKAVCKSKKSWQARRTGIKIVQQ

SEQ ID NO: 185 - protein, 40 aa, Artificial Sequence
  Description of Artificial Sequence: Synthetic polypeptide
ASALGIPSLLPFLKAVCKSKKSWQARRTGIKIVQQIAILM

SEQ ID NO: 186 - protein, 40 aa, Artificial Sequence
  Description of Artificial Sequence: Synthetic polypeptide
SLLPFLKAVCKSKKSWQARRTGIKIVQQIAILMGCAILPH

SEQ ID NO: 187 - protein, 40 aa, Artificial Sequence
  Description of Artificial Sequence: Synthetic polypeptide
PFLKAVCKSKKSWQARRTGIKIVQQIAILMGCAILPHLRS

SEQ ID NO: 188 - protein, 40 aa, Artificial Sequence
  Description of Artificial Sequence: Synthetic polypeptide
TARAFAVVASALGIPSLLPFLKAVCKSKKSWQARHPGIKI

SEQ ID NO: 189 - protein, 40 aa, Artificial Sequence
  Description of Artificial Sequence: Synthetic polypeptide
SLLPFLKAVCKSKKSWQARHPGIKIVQQIAILMGCAILPH

SEQ ID NO: 190 - protein, 40 aa, Artificial Sequence
  Description of Artificial Sequence: Synthetic polypeptide
PFLKAVCKSKKSWQARHPGIKIVQQIAILMGCAILPHLRS

SEQ ID NO: 191 - protein, 40 aa, Artificial Sequence
  Description of Artificial Sequence: Synthetic polypeptide
ALGIPSLLPFLKAVCKSKKSWQARHTGIEIVQQIAILMGC

SEQ ID NO: 192 - protein, 40 aa, Artificial Sequence
  Description of Artificial Sequence: Synthetic polypeptide
IPSLLPFLKAVCKSKKSWQARHTGIEIVQQIAILMGCAIL

SEQ ID NO: 193 - protein, 40 aa, Artificial Sequence
  Description of Artificial Sequence: Synthetic polypeptide
LKAVCKSKKSWQARHTGIEIVQQIAILMGCAILPHLRSLV

SEQ ID NO: 194 - protein, 40 aa, Artificial Sequence
  Description of Artificial Sequence: Synthetic polypeptide
ASALGIPSLLPFLKAVCKSKKSWQARHTGINIVQQIAILM

SEQ ID NO: 195 - protein, 40 aa, Artificial Sequence
  Description of Artificial Sequence: Synthetic polypeptide
IPSLLPFLKAVCKSKKSWQARHTGINIVQQIAILMGCAIL

SEQ ID NO: 196 - protein, 40 aa, Artificial Sequence
  Description of Artificial Sequence: Synthetic polypeptide
KSKKSWQARHTGINIVQQIAILMGCAILPHLRSLVEIIEH

SEQ ID NO: 197 - protein, 40 aa, Artificial Sequence
  Description of Artificial Sequence: Synthetic polypeptide
RAFAVVASALGIPSLLPFLKAVCKSKKSWQARHTGITIVQ

SEQ ID NO: 198 - protein, 40 aa, Artificial Sequence
  Description of Artificial Sequence: Synthetic polypeptide
ALGIPSLLPFLKAVCKSKKSWQARHTGITIVQQIAILMGC

SEQ ID NO: 199 - protein, 40 aa, Artificial Sequence
  Description of Artificial Sequence: Synthetic polypeptide
LKAVCKSKKSWQARHTGITIVQQIAILMGCAILPHLRSLV

SEQ ID NO: 200 - protein, 40 aa, Artificial Sequence
  Description of Artificial Sequence: Synthetic polypeptide
CKSKKSWQARHTGITIVQQIAILMGCAILPHLRSLVEIIE

SEQ ID NO: 201 - protein, 40 aa, Artificial Sequence
  Description of Artificial Sequence: Synthetic polypeptide
AATPYGIESFDSVLKPLWKGIRQHRGKGLAAVLKAIGYLI

SEQ ID NO: 202 - protein, 40 aa, Artificial Sequence
  Description of Artificial Sequence: Synthetic polypeptide
ATPYGIESFDSVLKPLWKGIRQHRGKGLAAVLKAIGYLIP

SEQ ID NO: 203 - protein, 40 aa, Artificial Sequence
  Description of Artificial Sequence: Synthetic polypeptide
GIESFDSVLKPLWKGIRQHRGKGLAAVLKAIGYLIPLMDA

SEQ ID NO: 204 - protein, 40 aa, Artificial Sequence
  Description of Artificial Sequence: Synthetic polypeptide
PLWKGIRQHRGKGLAAVLKAIGYLIPLMDAEYANYYTREV

SEQ ID NO: 205 - protein, 40 aa, Artificial Sequence
  Description of Artificial Sequence: Synthetic polypeptide
RRLCILRMSFVKGGGPDYPRQSIKETPCWIEIHLHRALQL

SEQ ID NO: 206 - protein, 40 aa, Artificial Sequence
  Description of Artificial Sequence: Synthetic polypeptide
RRLCILRMSFVKGWGPDYPRQSIKETPCLIEIHLHRALQL

SEQ ID NO: 207 - protein, 40 aa, Artificial Sequence
  Description of Artificial Sequence: Synthetic polypeptide
DLRRLCILRMSFVKGWGPDYPRQSIKETPCRIEIHLHRAL

SEQ ID NO: 208 - protein, 40 aa, Artificial Sequence
  Description of Artificial Sequence: Synthetic polypeptide
SLNLLLVSCPKSEVRAKFKFSILNAKGEETKAMESQRAYR

SEQ ID NO: 209 - protein, 40 aa, Artificial Sequence
  Description of Artificial Sequence: Synthetic polypeptide
LSSSVPSQKTYQCSYGFRLGFLHSGTAKSVTCTYSPALNK

SEQ ID NO: 210 - protein, 40 aa, Artificial Sequence
  Description of Artificial Sequence: Synthetic polypeptide
AAPAPAPSWPLSSSVPSQKTYQVSYGFRLGFLHSGTAKSV

SEQ ID NO: 211 - protein, 40 aa, Artificial Sequence
  Description of Artificial Sequence: Synthetic polypeptide
PAPAPSWPLSSSVPSQKTYQVSYGFRLGFLHSGTAKSVTC

SEQ ID NO: 212 - protein, 40 aa, Artificial Sequence
  Description of Artificial Sequence: Synthetic polypeptide
APAPSWPLSSSVPSQKTYQVSYGFRLGFLHSGTAKSVTCT

SEQ ID NO: 213 - protein, 40 aa, Artificial Sequence
  Description of Artificial Sequence: Synthetic polypeptide
WPLSSSVPSQKTYQVSYGFRLGFLHSGTAKSVTCTYSPAL

SEQ ID NO: 214 - protein, 40 aa, Artificial Sequence
  Description of Artificial Sequence: Synthetic polypeptide
SSSVPSQKTYQVSYGFRLGFLHSGTAKSVTCTYSPALNKM

SEQ ID NO: 215 - protein, 40 aa, Artificial Sequence
  Description of Artificial Sequence: Synthetic polypeptide
SSVPSQKTYQVSYGFRLGFLHSGTAKSVTCTYSPALNKMF

SEQ ID NO: 216 - protein, 40 aa, Artificial Sequence
  Description of Artificial Sequence: Synthetic polypeptide
SVPSQKTYQVSYGFRLGFLHSGTAKSVTCTYSPALNKMFC

SEQ ID NO: 217 - protein, 40 aa, Artificial Sequence
  Description of Artificial Sequence: Synthetic polypeptide
QVSYGFRLGFLHSGTAKSVTCTYSPALNKMFCQLAKTCPV

SEQ ID NO: 218 - protein, 40 aa, Artificial Sequence
  Description of Artificial Sequence: Synthetic polypeptide
AAPAPAPSWPLSSSVPSQKTYQGSYGSRLGFLHSGTAKSV

SEQ ID NO: 219 - protein, 40 aa, Artificial Sequence
  Description of Artificial Sequence: Synthetic polypeptide
WPLSSSVPSQKTYQGSYGSRLGFLHSGTAKSVTCTYSPAL

SEQ ID NO: 220 - protein, 40 aa, Artificial Sequence
  Description of Artificial Sequence: Synthetic polypeptide
APSWPLSSSVPSQKTYQGSYGVRLGFLHSGTAKSVTCTYS

SEQ ID NO: 221 - protein, 40 aa, Artificial Sequence
  Description of Artificial Sequence: Synthetic polypeptide
AAPTPAAPAPAPSWPLSSSVPSQKTYQGSYGFRRGFLHSG

SEQ ID NO: 222 - protein, 40 aa, Artificial Sequence
  Description of Artificial Sequence: Synthetic polypeptide
PAPSWPLSSSVPSQKTYQGSYGFRRGFLHSGTAKSVTCTY

SEQ ID NO: 223 - protein, 40 aa, Artificial Sequence
  Description of Artificial Sequence: Synthetic polypeptide
SVPSQKTYQGSYGFRRGFLHSGTAKSVTCTYSPALNKMFC

SEQ ID NO: 224 - protein, 40 aa, Artificial Sequence
  Description of Artificial Sequence: Synthetic polypeptide
YGFRRGFLHSGTAKSVTCTYSPALNKMFCQLAKTCPVQLW

SEQ ID NO: 225 - protein, 40 aa, Artificial Sequence
  Description of Artificial Sequence: Synthetic polypeptide
APAPAPSWPLSSSVPSQKTYQGSYGFRLGVLHSGTAKSVT

SEQ ID NO: 226 - protein, 40 aa, Artificial Sequence
  Description of Artificial Sequence: Synthetic polypeptide
PAPAPSWPLSSSVPSQKTYQGSYGFRLGVLHSGTAKSVTC

SEQ ID NO: 227 - protein, 40 aa, Artificial Sequence
  Description of Artificial Sequence: Synthetic polypeptide
APAPSWPLSSSVPSQKTYQGSYGFRLGVLHSGTAKSVTCT

SEQ ID NO: 228 - protein, 40 aa, Artificial Sequence
  Description of Artificial Sequence: Synthetic polypeptide
KTYQGSYGFRLGVLHSGTAKSVTCTYSPALNKMFCQLAKT

SEQ ID NO: 229 - protein, 40 aa, Artificial Sequence
  Description of Artificial Sequence: Synthetic polypeptide
GFRLGVLHSGTAKSVTCTYSPALNKMFCQLAKTCPVQLWV

SEQ ID NO: 230 - protein, 40 aa, Artificial Sequence
  Description of Artificial Sequence: Synthetic polypeptide
PAPAPSWPLSSSVPSQKTYQGSYGFRLGFLHSGTAKYVTC

SEQ ID NO: 231 - protein, 40 aa, Artificial Sequence
  Description of Artificial Sequence: Synthetic polypeptide
SSSVPSQKTYQGSYGFRLGFLHSGTAKYVTCTYSPALNKM

SEQ ID NO: 232 - protein, 40 aa, Artificial Sequence
  Description of Artificial Sequence: Synthetic polypeptide
LSSSVPSQKTYQGSYGFRLGFLHSGTAKSVTCMYSPALNK

SEQ ID NO: 233 - protein, 40 aa, Artificial Sequence
  Description of Artificial Sequence: Synthetic polypeptide
SSSVPSQKTYQGSYGFRLGFLHSGTAKSVTCMYSPALNKM

SEQ ID NO: 234 - protein, 40 aa, Artificial Sequence
  Description of Artificial Sequence: Synthetic polypeptide
APAPSWPLSSSVPSQKTYQGSYGFRLGFLHSGTAKSVTCP

SEQ ID NO: 235 - protein, 40 aa, Artificial Sequence
  Description of Artificial Sequence: Synthetic polypeptide
WPLSSSVPSQKTYQGSYGFRLGFLHSGTAKSVTCPYSPAL

SEQ ID NO: 236 - protein, 40 aa, Artificial Sequence
  Description of Artificial Sequence: Synthetic polypeptide
LSSSVPSQKTYQGSYGFRLGFLHSGTAKSVTCPYSPALNK

SEQ ID NO: 237 - protein, 40 aa, Artificial Sequence
  Description of Artificial Sequence: Synthetic polypeptide
SSVPSQKTYQGSYGFRLGFLHSGTAKSVTCPYSPALNKMF

SEQ ID NO: 238 - protein, 40 aa, Artificial Sequence
  Description of Artificial Sequence: Synthetic polypeptide
PAPSWPLSSSVPSQKTYQGSYGFRLGFLHSGTAKSVTCTS

SEQ ID NO: 239 - protein, 40 aa, Artificial Sequence
  Description of Artificial Sequence: Synthetic polypeptide
APSWPLSSSVPSQKTYQGSYGFRLGFLHSGTAKSVTCTSS

SEQ ID NO: 240 - protein, 40 aa, Artificial Sequence
  Description of Artificial Sequence: Synthetic polypeptide
TYQGSYGFRLGFLHSGTAKSVTCTSSPALNKMFCQLAKTC

SEQ ID NO: 241 - protein, 40 aa, Artificial Sequence
  Description of Artificial Sequence: Synthetic polypeptide
SWPLSSSVPSQKTYQGSYGFRLGFLHSGTAKSVTCTYPPA

SEQ ID NO: 242 - protein, 40 aa, Artificial Sequence
  Description of Artificial Sequence: Synthetic polypeptide
LSSSVPSQKTYQGSYGFRLGFLHSGTAKSVTCTYPPALNK

SEQ ID NO: 243 - protein, 40 aa, Artificial Sequence
  Description of Artificial Sequence: Synthetic polypeptide
APSWPLSSSVPSQKTYQGSYGFRLGFLHSGTAKSVTCTYY

SEQ ID NO: 244 - protein, 40 aa, Artificial Sequence
  Description of Artificial Sequence: Synthetic polypeptide
YYPALNKMFCQLAKTCPVQLWVDSTPPPGTRVRAMAIYKQ

SEQ ID NO: 245 - protein, 40 aa, Artificial Sequence
  Description of Artificial Sequence: Synthetic polypeptide
SSSVPSQKTYQGSYGFRLGFLHSGTAKSVTCTYSPARNKM

SEQ ID NO: 246 - protein, 40 aa, Artificial Sequence
  Description of Artificial Sequence: Synthetic polypeptide
VPSQKTYQGSYGFRLGFLHSGTAKSVTCTYSPARNKMFCQ

SEQ ID NO: 247 - protein, 40 aa, Artificial Sequence
  Description of Artificial Sequence: Synthetic polypeptide
LSSSVPSQKTYQGSYGFRLGFLHSGTAKSVTCTYSPAVNK

SEQ ID NO: 248 - protein, 40 aa, Artificial Sequence
  Description of Artificial Sequence: Synthetic polypeptide
TYSPAVNKMFCQLAKTCPVQLWVDSTPPPGTRVRAMAIYK

SEQ ID NO: 249 - protein, 40 aa, Artificial Sequence
  Description of Artificial Sequence: Synthetic polypeptide
YQGSYGFRLGFLHSGTAKSVTCTYSPALIKMFCQLAKTCP

SEQ ID NO: 250 - protein, 40 aa, Artificial Sequence
  Description of Artificial Sequence: Synthetic polypeptide
SSVPSQKTYQGSYGFRLGFLHSGTAKSVTCTYSPALNNMF

SEQ ID NO: 251 - protein, 40 aa, Artificial Sequence
  Description of Artificial Sequence: Synthetic polypeptide
TYQGSYGFRLGFLHSGTAKSVTCTYSPALNKMLCQLAKTC

SEQ ID NO: 252 - protein, 40 aa, Artificial Sequence
  Description of Artificial Sequence: Synthetic polypeptide
SPALNKMLCQLAKTCPVQLWVDSTPPPGTRVRAMAIYKQS

SEQ ID NO: 253 - protein, 40 aa, Artificial Sequence
  Description of Artificial Sequence: Synthetic polypeptide
KTYQGSYGFRLGFLHSGTAKSVTCTYSPALNKMFRQLAKT

SEQ ID NO: 254 - protein, 40 aa, Artificial Sequence
  Description of Artificial Sequence: Synthetic polypeptide
TAKSVTCTYSPALNKMFRQLAKTCPVQLWVDSTPPPGTRV

SEQ ID NO: 255 - protein, 40 aa, Artificial Sequence
  Description of Artificial Sequence: Synthetic polypeptide
ALNKMFRQLAKTCPVQLWVDSTPPPGTRVRAMAIYKQSQH

SEQ ID NO: 256 - protein, 40 aa, Artificial Sequence
  Description of Artificial Sequence: Synthetic polypeptide
SPALNKMFYQLAKTCPVQLWVDSTPPPGTRVRAMAIYKQS

SEQ ID NO: 257 - protein, 40 aa, Artificial Sequence
  Description of Artificial Sequence: Synthetic polypeptide
PALNKMFCHLAKTCPVQLWVDSTPPPGTRVRAMAIYKQSQ

SEQ ID NO: 258 - protein, 40 aa, Artificial Sequence
  Description of Artificial Sequence: Synthetic polypeptide
CHLAKTCPVQLWVDSTPPPGTRVRAMAIYKQSQHMTEVVR

SEQ ID NO: 259 - protein, 40 aa, Artificial Sequence
  Description of Artificial Sequence: Synthetic polypeptide
GSYGFRLGFLHSGTAKSVTCTYSPALNKMFCQQAKTCPVQ

SEQ ID NO: 260 - protein, 40 aa, Artificial Sequence
  Description of Artificial Sequence: Synthetic polypeptide
PALNKMFCQQAKTCPVQLWVDSTPPPGTRVRAMAIYKQSQ

SEQ ID NO: 261 - protein, 40 aa, Artificial Sequence
  Description of Artificial Sequence: Synthetic polypeptide
KSVTCTYSPALNKMFCQLAKTRPVQLWVDSTPPPGTRVRA

SEQ ID NO: 262 - protein, 40 aa, Artificial Sequence
  Description of Artificial Sequence: Synthetic polypeptide
PALNKMFCQLAKTRPVQLWVDSTPPPGTRVRAMAIYKQSQ

SEQ ID NO: 263 - protein, 40 aa, Artificial Sequence
  Description of Artificial Sequence: Synthetic polypeptide
NKMFCQLAKTRPVQLWVDSTPPPGTRVRAMAIYKQSQHMT

SEQ ID NO: 264 - protein, 40 aa, Artificial Sequence
  Description of Artificial Sequence: Synthetic polypeptide
CQLAKTRPVQLWVDSTPPPGTRVRAMAIYKQSQHMTEVVR

SEQ ID NO: 265 - protein, 40 aa, Artificial Sequence
  Description of Artificial Sequence: Synthetic polypeptide
TRPVQLWVDSTPPPGTRVRAMAIYKQSQHMTEVVRRCPHH

SEQ ID NO: 266 - protein, 40 aa, Artificial Sequence
  Description of Artificial Sequence: Synthetic polypeptide
SYGFRLGFLHSGTAKSVTCTYSPALNKMFCQLAKTYPVQL

SEQ ID NO: 267 - protein, 40 aa, Artificial Sequence
  Description of Artificial Sequence: Synthetic polypeptide
AKSVTCTYSPALNKMFCQLAKTYPVQLWVDSTPPPGTRVR

SEQ ID NO: 268 - protein, 40 aa, Artificial Sequence
  Description of Artificial Sequence: Synthetic polypeptide
QGSYGFRLGFLHSGTAKSVTCTYSPALNKMFCQLAKTCPA

SEQ ID NO: 269 - protein, 40 aa, Artificial Sequence
  Description of Artificial Sequence: Synthetic polypeptide
PALNKMFCQLAKTCPAQLWVDSTPPPGTRVRAMAIYKQSQ

SEQ ID NO: 270 - protein, 40 aa, Artificial Sequence
  Description of Artificial Sequence: Synthetic polypeptide
GSYGFRLGFLHSGTAKSVTCTYSPALNKMFCQLAKTCPMQ

SEQ ID NO: 271 - protein, 40 aa, Artificial Sequence
  Description of Artificial Sequence: Synthetic polypeptide
ALNKMFCQLAKTCPMQLWVDSTPPPGTRVRAMAIYKQSQH

SEQ ID NO: 272 - protein, 40 aa, Artificial Sequence
  Description of Artificial Sequence: Synthetic polypeptide
LAKTCPVHLWVDSTPPPGTRVRAMAIYKQSQHMTEVVRRC

SEQ ID NO: 273 - protein, 40 aa, Artificial Sequence
  Description of Artificial Sequence: Synthetic polypeptide
KTCPVHLWVDSTPPPGTRVRAMAIYKQSQHMTEVVRRCPH

SEQ ID NO: 274 - protein, 40 aa, Artificial Sequence
  Description of Artificial Sequence: Synthetic polypeptide
TCPVHLWVDSTPPPGTRVRAMAIYKQSQHMTEVVRRCPHH

SEQ ID NO: 275 - protein, 40 aa, Artificial Sequence
  Description of Artificial Sequence: Synthetic polypeptide
LAKTCPVPLWVDSTPPPGTRVRAMAIYKQSQHMTEVVRRC

SEQ ID NO: 276 - protein, 40 aa, Artificial Sequence
  Description of Artificial Sequence: Synthetic polypeptide
SPALNKMFCQLAKTCPVQPWVDSTPPPGTRVRAMAIYKQS

SEQ ID NO: 277 - protein, 40 aa, Artificial Sequence
  Description of Artificial Sequence: Synthetic polypeptide
QLAKTCPVQPWVDSTPPPGTRVRAMAIYKQSQHMTEVVRR

SEQ ID NO: 278 - protein, 40 aa, Artificial Sequence
  Description of Artificial Sequence: Synthetic polypeptide
PVQLWGDSTPPPGTRVRAMAIYKQSQHMTEVVRRCPHHER

SEQ ID NO: 279 - protein, 40 aa, Artificial Sequence
  Description of Artificial Sequence: Synthetic polypeptide
VQLWGDSTPPPGTRVRAMAIYKQSQHMTEVVRRCPHHERC

SEQ ID NO: 280 - protein, 40 aa, Artificial Sequence
  Description of Artificial Sequence: Synthetic polypeptide
LNKMFCQLAKTCPVQLWVDSTHPPGTRVRAMAIYKQSQHM

SEQ ID NO: 281 - protein, 40 aa, Artificial Sequence
  Description of Artificial Sequence: Synthetic polypeptide
YSPALNKMFCQLAKTCPVQLWVDSTPLPGTRVRAMAIYKQ

SEQ ID NO: 282 - protein, 40 aa, Artificial Sequence
  Description of Artificial Sequence: Synthetic polypeptide
AKSVTCTYSPALNKMFCQLAKTCPVQLWVDSTPSPGTRVR

SEQ ID NO: 283 - protein, 40 aa, Artificial Sequence
  Description of Artificial Sequence: Synthetic polypeptide
ALNKMFCQLAKTCPVQLWVDSTPSPGTRVRAMAIYKQSQH

SEQ ID NO: 284 - protein, 40 aa, Artificial Sequence
  Description of Artificial Sequence: Synthetic polypeptide
LAKTCPVQLWVDSTPSPGTRVRAMAIYKQSQHMTEVVRRC

SEQ ID NO: 285 - protein, 40 aa, Artificial Sequence
  Description of Artificial Sequence: Synthetic polypeptide
QLWVDSTPSPGTRVRAMAIYKQSQHMTEVVRRCPHHERCS

SEQ ID NO: 286 - protein, 40 aa, Artificial Sequence
  Description of Artificial Sequence: Synthetic polypeptide
QLAKTCPVQLWVDSTPPPGTRVRAMDIYKQSQHMTEVVRR

SEQ ID NO: 287 - protein, 40 aa, Artificial Sequence
  Description of Artificial Sequence: Synthetic polypeptide
QLWVDSTPPPGTRVRAMTIYKQSQHMTEVVRRCPHHERCS

SEQ ID NO: 288 - protein, 40 aa, Artificial Sequence
  Description of Artificial Sequence: Synthetic polypeptide
PALNKMFCQLAKTCPVQLWVDSTPPPGTRVRAMAFYKQSQ

SEQ ID NO: 289 - protein, 40 aa, Artificial Sequence
  Description of Artificial Sequence: Synthetic polypeptide
PVQLWVDSTPPPGTRVRAMAFYKQSQHMTEVVRRCPHHER

SEQ ID NO: 290 - protein, 40 aa, Artificial Sequence
  Description of Artificial Sequence: Synthetic polypeptide
PVQLWVDSTPPPGTRVRAMANYKQSQHMTEVVRRCPHHER

SEQ ID NO: 291 - protein, 40 aa, Artificial Sequence
  Description of Artificial Sequence: Synthetic polypeptide
PALNKMFCQLAKTCPVQLWVDSTPPPGTRVRAMAICKQSQ

SEQ ID NO: 292 - protein, 40 aa, Artificial Sequence
  Description of Artificial Sequence: Synthetic polypeptide
CQLAKTCPVQLWVDSTPPPGTRVRAMAIHKQSQHMTEVVR

SEQ ID NO: 293 - protein, 40 aa, Artificial Sequence
  Description of Artificial Sequence: Synthetic polypeptide
QLAKTCPVQLWVDSTPPPGTRVRAMAIHKQSQHMTEVVRR

SEQ ID NO: 294 - protein, 40 aa, Artificial Sequence
  Description of Artificial Sequence: Synthetic polypeptide
AKTCPVQLWVDSTPPPGTRVRAMAIHKQSQHMTEVVRRCP

SEQ ID NO: 295 - protein, 40 aa, Artificial Sequence
  Description of Artificial Sequence: Synthetic polypeptide
CQLAKTCPVQLWVDSTPPPGTRVRAMAIYKQSQHMTKVVR

SEQ ID NO: 296 - protein, 40 aa, Artificial Sequence
  Description of Artificial Sequence: Synthetic polypeptide
VQLWVDSTPPPGTRVRAMAIYKQSQHMTKVVRRCPHHERC

SEQ ID NO: 297 - protein, 40 aa, Artificial Sequence
  Description of Artificial Sequence: Synthetic polypeptide
LWVDSTPPPGTRVRAMAIYKQSQHMTKVVRRCPHHERCSD

SEQ ID NO: 298 - protein, 40 aa, Artificial Sequence
  Description of Artificial Sequence: Synthetic polypeptide
KTCPVQLWVDSTPPPGTRVRAMAIYKQSQHMTEDVRRCPH

SEQ ID NO: 299 - protein, 40 aa, Artificial Sequence
  Description of Artificial Sequence: Synthetic polypeptide
PVQLWVDSTPPPGTRVRAMAIYKQSQHMTEFVRRCPHHER

SEQ ID NO: 300 - protein, 40 aa, Artificial Sequence
  Description of Artificial Sequence: Synthetic polypeptide
LAKTCPVQLWVDSTPPPGTRVRAMAIYKQSQHMTEVGRRC

SEQ ID NO: 301 - protein, 40 aa, Artificial Sequence
  Description of Artificial Sequence: Synthetic polypeptide
LAKTCPVQLWVDSTPPPGTRVRAMAIYKQSQHMTEVVRRF

SEQ ID NO: 302 - protein, 40 aa, Artificial Sequence
  Description of Artificial Sequence: Synthetic polypeptide
TCPVQLWVDSTPPPGTRVRAMAIYKQSQHMTEVVRRRPHH

SEQ ID NO: 303 - protein, 40 aa, Artificial Sequence
  Description of Artificial Sequence: Synthetic polypeptide
CPVQLWVDSTPPPGTRVRAMAIYKQSQHMTEVVRRRPHHE

SEQ ID NO: 304 - protein, 40 aa, Artificial Sequence
  Description of Artificial Sequence: Synthetic polypeptide
STPPPGTRVRAMAIYKQSQHMTEVVRRRPHHERCSDSDGL

SEQ ID NO: 305 - protein, 40 aa, Artificial Sequence
  Description of Artificial Sequence: Synthetic polypeptide
LWVDSTPPPGTRVRAMAIYKQSQHMTEVVRRCRHHERCSD

SEQ ID NO: 306 - protein, 40 aa, Artificial Sequence
  Description of Artificial Sequence: Synthetic polypeptide
VQLWVDSTPPPGTRVRAMAIYKQSQHMTEVVRRCPQHERC

SEQ ID NO: 307 - protein, 40 aa, Artificial Sequence
  Description of Artificial Sequence: Synthetic polypeptide
RVRAMAIYKQSQHMTEVVRRCPHRERCSDSDGLAPPQHLI

SEQ ID NO: 308 - protein, 40 aa, Artificial Sequence
  Description of Artificial Sequence: Synthetic polypeptide
WVDSTPPPGTRVRAMAIYKQSQHMTEVVRRCPHHKRCSDS

SEQ ID NO: 309 - protein, 40 aa, Artificial Sequence
  Description of Artificial Sequence: Synthetic polypeptide
VRAMAIYKQSQHMTEVVRRCPHHERCSDSDGLAPPQRLIR

SEQ ID NO: 310 - protein, 40 aa, Artificial Sequence
  Description of Artificial Sequence: Synthetic polypeptide
GGMNRRPILTIITLGDSSGNLLGRNSFEVRVCACPGRDRR

SEQ ID NO: 311 - protein, 40 aa, Artificial Sequence
  Description of Artificial Sequence: Synthetic polypeptide
MGGMNRRPILTIITLKDSSGNLLGRNSFEVRVCACPGRDR

SEQ ID NO: 312 - protein, 40 aa, Artificial Sequence
  Description of Artificial Sequence: Synthetic polypeptide
GGMNRRPILTIITLKDSSGNLLGRNSFEVRVCACPGRDRR

SEQ ID NO: 313 - protein, 40 aa, Artificial Sequence
  Description of Artificial Sequence: Synthetic polypeptide
GGMNRRPILTIITLEVSSGNLLGRNSFEVRVCACPGRDRR

SEQ ID NO: 314 - protein, 40 aa, Artificial Sequence
  Description of Artificial Sequence: Synthetic polypeptide
GGMNRRPILTIITLEYSSGNLLGRNSFEVRVCACPGRDRR

SEQ ID NO: 315 - protein, 40 aa, Artificial Sequence
  Description of Artificial Sequence: Synthetic polypeptide
GGMNRRPILTIITLEDSSGNLLRRNSFEVRVCACPGRDRR

SEQ ID NO: 316 - protein, 40 aa, Artificial Sequence
  Description of Artificial Sequence: Synthetic polypeptide
GMNRRPILTIITLEDSSGNLLRRNSFEVRVCACPGRDRRT

SEQ ID NO: 317 - protein, 40 aa, Artificial Sequence
  Description of Artificial Sequence: Synthetic polypeptide
SCMGGMNRRPILTIITLEDSSGNLLGRNSFKVRVCACPGR

SEQ ID NO: 318 - protein, 40 aa, Artificial Sequence
  Description of Artificial Sequence: Synthetic polypeptide
GGMNRRPILTIITLEDSSGNLLGRNSFKVRVCACPGRDRR

SEQ ID NO: 319 - protein, 40 aa, Artificial Sequence
  Description of Artificial Sequence: Synthetic polypeptide
GMNRRPILTIITLEDSSGNLLGRNSFKVRVCACPGRDRRT

SEQ ID NO: 320 - protein, 40 aa, Artificial Sequence
  Description of Artificial Sequence: Synthetic polypeptide
MNRRPILTIITLEDSSGNLLGRNSFKVRVCACPGRDRRTE

SEQ ID NO: 321 - protein, 40 aa, Artificial Sequence
  Description of Artificial Sequence: Synthetic polypeptide
GMNRRPILTIITLEDSSGNLLGRNSFVVRVCACPGRDRRT

SEQ ID NO: 322 - protein, 40 aa, Artificial Sequence
  Description of Artificial Sequence: Synthetic polypeptide
RVYACPGRDRRTEEENLRKKGEPHHELPPGSTKRALPNNT

SEQ ID NO: 323 - protein, 40 aa, Artificial Sequence
  Description of Artificial Sequence: Synthetic polypeptide
RVCPCPGRDRRTEEENLRKKGEPHHELPPGSTKRALPNNT

SEQ ID NO: 324 - protein, 40 aa, Artificial Sequence
  Description of Artificial Sequence: Synthetic polypeptide
VRVCAYPGRDRRTEEENLRKKGEPHHELPPGSTKRALPNN

SEQ ID NO: 325 - protein, 40 aa, Artificial Sequence
  Description of Artificial Sequence: Synthetic polypeptide
GRNSFEVRVCACRGRDRRTEEENLRKKGEPHHELPPGSTK

SEQ ID NO: 326 - protein, 40 aa, Artificial Sequence
  Description of Artificial Sequence: Synthetic polypeptide
VCACPRRDRRTEEENLRKKGEPHHELPPGSTKRALPNNTS

SEQ ID NO: 327 - protein, 40 aa, Artificial Sequence
  Description of Artificial Sequence: Synthetic polypeptide
RNSFEVRVCACPGKDRRTEEENLRKKGEPHHELPPGSTKR

SEQ ID NO: 328 - protein, 40 aa, Artificial Sequence
  Description of Artificial Sequence: Synthetic polypeptide
GGMNRRPILTIITLEDSSGNLLGRNSFEVRVCACPGRVRR

SEQ ID NO: 329 - protein, 40 aa, Artificial Sequence
  Description of Artificial Sequence: Synthetic polypeptide
GMNRRPILTIITLEDSSGNLLGRNSFEVRVCACPGRVRRT

SEQ ID NO: 330 - protein, 40 aa, Artificial Sequence
  Description of Artificial Sequence: Synthetic polypeptide
CPGRVRRTEEENLRKKGEPHHELPPGSTKRALPNNTSSSP

SEQ ID NO: 331 - protein, 40 aa, Artificial Sequence
  Description of Artificial Sequence: Synthetic polypeptide
PTEEENLRKKGEPHHELPPGSTKRALPNNTSSSPQPKKKP

SEQ ID NO: 332 - protein, 40 aa, Artificial Sequence
  Description of Artificial Sequence: Synthetic polypeptide
MNRRPILTIITLEDSSGNLLGRNSFEVRVCACPGRDRRTK

SEQ ID NO: 333 - protein, 40 aa, Artificial Sequence
  Description of Artificial Sequence: Synthetic polypeptide
FEVRVCACPGRDRRTEGENLRKKGEPHHELPPGSTKRALP

SEQ ID NO: 334 - protein, 40 aa, Artificial Sequence
  Description of Artificial Sequence: Synthetic polypeptide
PGRDRRTEGENLRKKGEPHHELPPGSTKRALPNNTSSSPQ

SEQ ID NO: 335 - protein, 40 aa, Artificial Sequence
  Description of Artificial Sequence: Synthetic polypeptide
EQENLRKKGEPHHELPPGSTKRALPNNTSSSPQPKKKPLD

SEQ ID NO: 336 - protein, 40 aa, Artificial Sequence
  Description of Artificial Sequence: Synthetic polypeptide
HELPPGSTKRALPNNTSSSPQPKKKPLDGEYFTLQFRGRE

SEQ ID NO: 337 - protein, 40 aa, Artificial Sequence
  Description of Artificial Sequence: Synthetic polypeptide
PHHELPPGSTKRALPNNTSSSPQPKKKPLDGEYFTLQIRV

SEQ ID NO: 338 - protein, 40 aa, Artificial Sequence
  Description of Artificial Sequence: Synthetic polypeptide
HELPPGSTKRALPNNTSSSPQPKKKPLDGEYFTLQIRVRE

SEQ ID NO: 339 - protein, 40 aa, Artificial Sequence
  Description of Artificial Sequence: Synthetic polypeptide
HELPPGSTKRALPNNTSSSPQPKKKPLDGEYFTLQIRWRE

SEQ ID NO: 340 - protein, 40 aa, Artificial Sequence
  Description of Artificial Sequence: Synthetic polypeptide
ELPPGSTKRALPNNTSSSPQPKKKPLDGEYFTLQIRGREH

SEQ ID NO: 341 - protein, 40 aa, Artificial Sequence
  Description of Artificial Sequence: Synthetic polypeptide
ELPPGSTKRALPNNTSSSPQPKKKPLDGEYFTLQIRGRES

SEQ ID NO: 342 - protein, 40 aa, Artificial Sequence
  Description of Artificial Sequence: Synthetic polypeptide
FCNRSPRVVLPVWLNFDGEPQPYPTLPPGTGRRIHSYRGN

SEQ ID NO: 343 - protein, 40 aa, Artificial Sequence
  Description of Artificial Sequence: Synthetic polypeptide
CNRSPRVVLPVWLNFDGEPQPYPTLPPGTGRRIHSYRGNL

SEQ ID NO: 344 - protein, 40 aa, Artificial Sequence
  Description of Artificial Sequence: Synthetic polypeptide
NRSPRVVLPVWLNFDGEPQPYPTLPPGTGRRIHSYRGNLW

SEQ ID NO: 345 - protein, 40 aa, Artificial Sequence
  Description of Artificial Sequence: Synthetic polypeptide
PRVVLPVWLNFDGEPQPYPTLPPGTGRRIHSYRGNLWLFR

SEQ ID NO: 346 - protein, 40 aa, Artificial Sequence
  Description of Artificial Sequence: Synthetic polypeptide
PRVVLPVWLNFDGEPQPYPTLPPGTGRRIHSYRGHLWPFR

SEQ ID NO: 347 - protein, 40 aa, Artificial Sequence
  Description of Artificial Sequence: Synthetic polypeptide
QPIFANITPPVYTLKERCLQVVRSLVKPENYRRLDIVRSL

SEQ ID NO: 348 - protein, 40 aa, Artificial Sequence
  Description of Artificial Sequence: Synthetic polypeptide
PIFANITPPVYTLKERCLQVVRSLVKPENYRRLDIVRSLY

SEQ ID NO: 349 - protein, 40 aa, Artificial Sequence
  Description of Artificial Sequence: Synthetic polypeptide
ANITLPVYTLKERRLQVVRSLVKPENYRRLDIVRSLYEDL

SEQ ID NO: 350 - protein, 40 aa, Artificial Sequence
  Description of Artificial Sequence: Synthetic polypeptide
SDDWEIPDGQITVGQRIVSGSFGTVYKGKWHGDVAVKMLN

SEQ ID NO: 351 - protein, 40 aa, Artificial Sequence
  Description of Artificial Sequence: Synthetic polypeptide
KSSSSSEDRNRMKTLGRRDSSDDWEIPDGQITVGQRIGSE

SEQ ID NO: 352 - protein, 40 aa, Artificial Sequence
  Description of Artificial Sequence: Synthetic polypeptide
DDWEIPDGQITVGQRIGSESFGTVYKGKWHGDVAVKMLNV

SEQ ID NO: 353 - protein, 40 aa, Artificial Sequence
  Description of Artificial Sequence: Synthetic polypeptide
VGQRIGSESFGTVYKGKWHGDVAVKMLNVTAPTPQQLQAF

SEQ ID NO: 354 - protein, 40 aa, Artificial Sequence
  Description of Artificial Sequence: Synthetic polypeptide
IGSGLFGTVYKGKWHGDVAVKMLNVTAPTPQQLQAFKNEV

SEQ ID NO: 355 - protein, 40 aa, Artificial Sequence
  Description of Artificial Sequence: Synthetic polypeptide
GRRDSSDDWEIPDGQITVGQRIGSGSCGTVYKGKWHGDVA

SEQ ID NO: 356 - protein, 40 aa, Artificial Sequence
  Description of Artificial Sequence: Synthetic polypeptide
SSEDRNRMKTLGRRDSSDDWEIPDGQITVGQRIGSGSFAT

SEQ ID NO: 357 - protein, 40 aa, Artificial Sequence
  Description of Artificial Sequence: Synthetic polypeptide
MKTLGRRDSSDDWEIPDGQITVGQRIGSGSFATVYKGKWH

SEQ ID NO: 358 - protein, 40 aa, Artificial Sequence
  Description of Artificial Sequence: Synthetic polypeptide
SSEDRNRMKTLGRRDSSDDWEIPDGQITVGQRIGSGSFRT

SEQ ID NO: 359 - protein, 40 aa, Artificial Sequence
  Description of Artificial Sequence: Synthetic polypeptide
RRDSSDDWEIPDGQITVGQRIGSGSFRTVYKGKWHGDVAV

SEQ ID NO: 360 - protein, 40 aa, Artificial Sequence
  Description of Artificial Sequence: Synthetic polypeptide
TKFEMIKLIDIARQTAQGMDYLDAKSIIHRDLKSNNIFLH

SEQ ID NO: 361 - protein, 40 aa, Artificial Sequence
  Description of Artificial Sequence: Synthetic polypeptide
KFEMIKLIDIARQTAQGMDYLDAKSIIHRDLKSNNIFLHE

SEQ ID NO: 362 - protein, 40 aa, Artificial Sequence
  Description of Artificial Sequence: Synthetic polypeptide
FEMIKLIDIARQTAQGMDYLDAKSIIHRDLKSNNIFLHED

SEQ ID NO: 363 - protein, 40 aa, Artificial Sequence
  Description of Artificial Sequence: Synthetic polypeptide
MIKLIDIARQTAQGMDYLDAKSIIHRDLKSNNIFLHEDLT

SEQ ID NO: 364 - protein, 40 aa, Artificial Sequence
  Description of Artificial Sequence: Synthetic polypeptide
KLIDIARQTAQGMDYLDAKSIIHRDLKSNNIFLHEDLTVK

SEQ ID NO: 365 - protein, 40 aa, Artificial Sequence
  Description of Artificial Sequence: Synthetic polypeptide
LIDIARQTAQGMDYLDAKSIIHRDLKSNNIFLHEDLTVKI

SEQ ID NO: 366 - protein, 40 aa, Artificial Sequence
  Description of Artificial Sequence: Synthetic polypeptide
IDIARQTAQGMDYLDAKSIIHRDLKSNNIFLHEDLTVKIG

SEQ ID NO: 367 - protein, 40 aa, Artificial Sequence
  Description of Artificial Sequence: Synthetic polypeptide
IARQTAQGMDYLDAKSIIHRDLKSNNIFLHEDLTVKIGDF

SEQ ID NO: 368 - protein, 40 aa, Artificial Sequence
  Description of Artificial Sequence: Synthetic polypeptide
ARQTAQGMDYLDAKSIIHRDLKSNNIFLHEDLTVKIGDFG

SEQ ID NO: 369 - protein, 40 aa, Artificial Sequence
  Description of Artificial Sequence: Synthetic polypeptide
RQTAQGMDYLDAKSIIHRDLKSNNIFLHEDLTVKIGDFGL

SEQ ID NO: 370 - protein, 40 aa, Artificial Sequence
  Description of Artificial Sequence: Synthetic polypeptide
QTAQGMDYLDAKSIIHRDLKSNNIFLHEDLTVKIGDFGLA

SEQ ID NO: 371 - protein, 40 aa, Artificial Sequence
  Description of Artificial Sequence: Synthetic polypeptide
AQGMDYLDAKSIIHRDLKSNNIFLHEDLTVKIGDFGLATV

SEQ ID NO: 372 - protein, 40 aa, Artificial Sequence
  Description of Artificial Sequence: Synthetic polypeptide
QGMDYLDAKSIIHRDLKSNNIFLHEDLTVKIGDFGLATVK

SEQ ID NO: 373 - protein, 40 aa, Artificial Sequence
  Description of Artificial Sequence: Synthetic polypeptide
GMDYLDAKSIIHRDLKSNNIFLHEDLTVKIGDFGLATVKS

SEQ ID NO: 374 - protein, 40 aa, Artificial Sequence
  Description of Artificial Sequence: Synthetic polypeptide
MDYLDAKSIIHRDLKSNNIFLHEDLTVKIGDFGLATVKSR

SEQ ID NO: 375 - protein, 40 aa, Artificial Sequence
  Description of Artificial Sequence: Synthetic polypeptide
DYLDAKSIIHRDLKSNNIFLHEDLTVKIGDFGLATVKSRW

SEQ ID NO: 376 - protein, 40 aa, Artificial Sequence
  Description of Artificial Sequence: Synthetic polypeptide
YLDAKSIIHRDLKSNNIFLHEDLTVKIGDFGLATVKSRWS

SEQ ID NO: 377 - protein, 40 aa, Artificial Sequence
  Description of Artificial Sequence: Synthetic polypeptide
LDAKSIIHRDLKSNNIFLHEDLTVKIGDFGLATVKSRWSG

SEQ ID NO: 378 - protein, 40 aa, Artificial Sequence
  Description of Artificial Sequence: Synthetic polypeptide
DAKSIIHRDLKSNNIFLHEDLTVKIGDFGLATVKSRWSGS

SEQ ID NO: 379 - protein, 40 aa, Artificial Sequence
  Description of Artificial Sequence: Synthetic polypeptide
IETKFEMIKLIDIARQTAQGMDYLHAKSIIHKDLKSNNIF

SEQ ID NO: 380 - protein, 40 aa, Artificial Sequence
  Description of Artificial Sequence: Synthetic polypeptide
ETKFEMIKLIDIARQTAQGMDYLHAKSIIHKDLKSNNIFL

SEQ ID NO: 381 - protein, 40 aa, Artificial Sequence
  Description of Artificial Sequence: Synthetic polypeptide
TKFEMIKLIDIARQTAQGMDYLHAKSIIHKDLKSNNIFLH

SEQ ID NO: 382 - protein, 40 aa, Artificial Sequence
  Description of Artificial Sequence: Synthetic polypeptide
KFEMIKLIDIARQTAQGMDYLHAKSIIHKDLKSNNIFLHE

SEQ ID NO: 383 - protein, 40 aa, Artificial Sequence
  Description of Artificial Sequence: Synthetic polypeptide
IARQTAQGMDYLHAKSIIHKDLKSNNIFLHEDLTVKIGDF

SEQ ID NO: 384 - protein, 40 aa, Artificial Sequence
  Description of Artificial Sequence: Synthetic polypeptide
AQGMDYLHAKSIIHKDLKSNNIFLHEDLTVKIGDFGLATV

SEQ ID NO: 385 - protein, 40 aa, Artificial Sequence
  Description of Artificial Sequence: Synthetic polypeptide
DYLHAKSIIHKDLKSNNIFLHEDLTVKIGDFGLATVKSRW

SEQ ID NO: 386 - protein, 40 aa, Artificial Sequence
  Description of Artificial Sequence: Synthetic polypeptide
AKSIIHKDLKSNNIFLHEDLTVKIGDFGLATVKSRWSGSH

SEQ ID NO: 387 - protein, 40 aa, Artificial Sequence
  Description of Artificial Sequence: Synthetic polypeptide
KSIIHKDLKSNNIFLHEDLTVKIGDFGLATVKSRWSGSHQ

SEQ ID NO: 388 - protein, 40 aa, Artificial Sequence
  Description of Artificial Sequence: Synthetic polypeptide
SIIHKDLKSNNIFLHEDLTVKIGDFGLATVKSRWSGSHQF

SEQ ID NO: 389 - protein, 40 aa, Artificial Sequence
  Description of Artificial Sequence: Synthetic polypeptide
IIHKDLKSNNIFLHEDLTVKIGDFGLATVKSRWSGSHQFE

SEQ ID NO: 390 - protein, 40 aa, Artificial Sequence
  Description of Artificial Sequence: Synthetic polypeptide
KDLKSNNIFLHEDLTVKIGDFGLATVKSRWSGSHQFEQLS

SEQ ID NO: 391 - protein, 40 aa, Artificial Sequence
  Description of Artificial Sequence: Synthetic polypeptide
KSNIIFLHEDLTVKIGDFGLATVKSRWSGSHQFEQLSGSI

SEQ ID NO: 392 - protein, 40 aa, Artificial Sequence
  Description of Artificial Sequence: Synthetic polypeptide
QGMDYLHAKSIIHRDLKSNNIFLHEDLTVKIGGFGLATVK

SEQ ID NO: 393 - protein, 40 aa, Artificial Sequence
  Description of Artificial Sequence: Synthetic polypeptide
GMDYLHAKSIIHRDLKSNNIFLHEDLTVKIGGFGLATVKS

SEQ ID NO: 394 - protein, 40 aa, Artificial Sequence
  Description of Artificial Sequence: Synthetic polypeptide
MDYLHAKSIIHRDLKSNNIFLHEDLTVKIGGFGLATVKSR

SEQ ID NO: 395 - protein, 40 aa, Artificial Sequence
  Description of Artificial Sequence: Synthetic polypeptide
DYLHAKSIIHRDLKSNNIFLHEDLTVKIGGFGLATVKSRW

SEQ ID NO: 396 - protein, 40 aa, Artificial Sequence
  Description of Artificial Sequence: Synthetic polypeptide
SIIHRDLKSNNIFLHEDLTVKIGGFGLATVKSRWSGSHQF

SEQ ID NO: 397 - protein, 40 aa, Artificial Sequence
  Description of Artificial Sequence: Synthetic polypeptide
IHRDLKSNNIFLHEDLTVKIGGFGLATVKSRWSGSHQFEQ

SEQ ID NO: 398 - protein, 40 aa, Artificial Sequence
  Description of Artificial Sequence: Synthetic polypeptide
RDLKSNNIFLHEDLTVKIGGFGLATVKSRWSGSHQFEQLS

SEQ ID NO: 399 - protein, 40 aa, Artificial Sequence
  Description of Artificial Sequence: Synthetic polypeptide
LKSNNIFLHEDLTVKIGGFGLATVKSRWSGSHQFEQLSGS

SEQ ID NO: 400 - protein, 40 aa, Artificial Sequence
  Description of Artificial Sequence: Synthetic polypeptide
NNIFLHEDLTVKIGGFGLATVKSRWSGSHQFEQLSGSILW

SEQ ID NO: 401 - protein, 40 aa, Artificial Sequence
  Description of Artificial Sequence: Synthetic polypeptide
RQTAQGMDYLHAKSIIHRDLKSNNIFLHEDLTVKIGNFGL

SEQ ID NO: 402 - protein, 40 aa, Artificial Sequence
  Description of Artificial Sequence: Synthetic polypeptide
AQGMDYLHAKSIIHRDLKSNNIFLHEDLTVKIGNFGLATV

SEQ ID NO: 403 - protein, 40 aa, Artificial Sequence
  Description of Artificial Sequence: Synthetic polypeptide
QGMDYLHAKSIIHRDLKSNNIFLHEDLTVKIGNFGLATVK

SEQ ID NO: 404 - protein, 40 aa, Artificial Sequence
  Description of Artificial Sequence: Synthetic polypeptide
GMDYLHAKSIIHRDLKSNNIFLHEDLTVKIGNFGLATVKS

SEQ ID NO: 405 - protein, 40 aa, Artificial Sequence
  Description of Artificial Sequence: Synthetic polypeptide
MDYLHAKSIIHRDLKSNNIFLHEDLTVKIGNFGLATVKSR

SEQ ID NO: 406 - protein, 40 aa, Artificial Sequence
  Description of Artificial Sequence: Synthetic polypeptide
DYLHAKSIIHRDLKSNNIFLHEDLTVKIGNFGLATVKSRW

SEQ ID NO: 407 - protein, 40 aa, Artificial Sequence
  Description of Artificial Sequence: Synthetic polypeptide
SIIHRDLKSNNIFLHEDLTVKIGNFGLATVKSRWSGSHQF

SEQ ID NO: 408 - protein, 40 aa, Artificial Sequence
  Description of Artificial Sequence: Synthetic polypeptide
IIHRDLKSNNIFLHEDLTVKIGNFGLATVKSRWSGSHQFE

SEQ ID NO: 409 - protein, 40 aa, Artificial Sequence
  Description of Artificial Sequence: Synthetic polypeptide
IHRDLKSNNIFLHEDLTVKIGNFGLATVKSRWSGSHQFEQ

SEQ ID NO: 410 - protein, 40 aa, Artificial Sequence
  Description of Artificial Sequence: Synthetic polypeptide
HRDLKSNNIFLHEDLTVKIGNFGLATVKSRWSGSHQFEQL

SEQ ID NO: 411 - protein, 40 aa, Artificial Sequence
  Description of Artificial Sequence: Synthetic polypeptide
RDLKSNNIFLHEDLTVKIGNFGLATVKSRWSGSHQFEQLS

SEQ ID NO: 412 - protein, 40 aa, Artificial Sequence
  Description of Artificial Sequence: Synthetic polypeptide
DLKSNNIFLHEDLTVKIGNFGLATVKSRWSGSHQFEQLSG

SEQ ID NO: 413 - protein, 40 aa, Artificial Sequence
  Description of Artificial Sequence: Synthetic polypeptide
LKSNNIFLHEDLTVKIGNFGLATVKSRWSGSHQFEQLSGS

SEQ ID NO: 414 - protein, 40 aa, Artificial Sequence
  Description of Artificial Sequence: Synthetic polypeptide
KSNNIFLHEDLTVKIGNFGLATVKSRWSGSHQFEQLSGSI

SEQ ID NO: 415 - protein, 40 aa, Artificial Sequence
  Description of Artificial Sequence: Synthetic polypeptide
SNNIFLHEDLTVKIGNFGLATVKSRWSGSHQFEQLSGSIL

SEQ ID NO: 416 - protein, 40 aa, Artificial Sequence
  Description of Artificial Sequence: Synthetic polypeptide
NNIFLHEDLTVKIGNFGLATVKSRWSGSHQFEQLSGSILW

SEQ ID NO: 417 - protein, 40 aa, Artificial Sequence
  Description of Artificial Sequence: Synthetic polypeptide
YLHAKSIIHRDLKSNNIFLHEDLTVKIGDFDLATVKSRWS

SEQ ID NO: 418 - protein, 40 aa, Artificial Sequence
  Description of Artificial Sequence: Synthetic polypeptide
AKSIIHRDLKSNNIFLHEDLTVKIGDFDLATVKSRWSGSH

SEQ ID NO: 419 - protein, 40 aa, Artificial Sequence
  Description of Artificial Sequence: Synthetic polypeptide
KSIIHRDLKSNNIFLHEDLTVKIGDFDLATVKSRWSGSHQ

SEQ ID NO: 420 - protein, 40 aa, Artificial Sequence
  Description of Artificial Sequence: Synthetic polypeptide
SIIHRDLKSNNIFLHEDLTVKIGDFDLATVKSRWSGSHQF

SEQ ID NO: 421 - protein, 40 aa, Artificial Sequence
  Description of Artificial Sequence: Synthetic polypeptide
IIHRDLKSNNIFLHEDLTVKIGDFDLATVKSRWSGSHQFE

SEQ ID NO: 422 - protein, 40 aa, Artificial Sequence
  Description of Artificial Sequence: Synthetic polypeptide
IHRDLKSNNIFLHEDLTVKIGDFDLATVKSRWSGSHQFEQ

SEQ ID NO: 423 - protein, 40 aa, Artificial Sequence
  Description of Artificial Sequence: Synthetic polypeptide
RDLKSNNIFLHEDLTVKIGDFDLATVKSRWSGSHQFEQLS

SEQ ID NO: 424 - protein, 40 aa, Artificial Sequence
  Description of Artificial Sequence: Synthetic polypeptide
DLKSNNIFLHEDLTVKIGDFDLATVKSRWSGSHQFEQLSG

SEQ ID NO: 425 - protein, 40 aa, Artificial Sequence
  Description of Artificial Sequence: Synthetic polypeptide
LKSNNIFLHEDLTVKIGDFDLATVKSRWSGSHQFEQLSGS

SEQ ID NO: 426 - protein, 40 aa, Artificial Sequence
  Description of Artificial Sequence: Synthetic polypeptide
KSNNIFLHEDLTVKIGDFDLATVKSRWSGSHQFEQLSGSI

SEQ ID NO: 427 - protein, 40 aa, Artificial Sequence
  Description of Artificial Sequence: Synthetic polypeptide
NNIFLHEDLTVKIGDFDLATVKSRWSGSHQFEQLSGSILW

SEQ ID NO: 428 - protein, 40 aa, Artificial Sequence
  Description of Artificial Sequence: Synthetic polypeptide
HEDLTVKIGDFDLATVKSRWSGSHQFEQLSGSILWMAPEV

SEQ ID NO: 429 - protein, 40 aa, Artificial Sequence
  Description of Artificial Sequence: Synthetic polypeptide
MDYLHAKSIIHRDLKSNNIFLHEDLTVKIGDFSLATVKSR

SEQ ID NO: 430 - protein, 40 aa, Artificial Sequence
  Description of Artificial Sequence: Synthetic polypeptide
DYLHAKSIIHRDLKSNNIFLHEDLTVKIGDFSLATVKSRW

SEQ ID NO: 431 - protein, 40 aa, Artificial Sequence
  Description of Artificial Sequence: Synthetic polypeptide
AKSIIHRDLKSNNIFLHEDLTVKIGDFSLATVKSRWSGSH

SEQ ID NO: 432 - protein, 40 aa, Artificial Sequence
  Description of Artificial Sequence: Synthetic polypeptide
KSIIHRDLKSNNIFLHEDLTVKIGDFSLATVKSRWSGSHQ

SEQ ID NO: 433 - protein, 40 aa, Artificial Sequence
  Description of Artificial Sequence: Synthetic polypeptide
SIIHRDLKSNNIFLHEDLTVKIGDFSLATVKSRWSGSHQF

SEQ ID NO: 434 - protein, 40 aa, Artificial Sequence
  Description of Artificial Sequence: Synthetic polypeptide
IIHRDLKSNNIFLHEDLTVKIGDFSLATVKSRWSGSHQFE

SEQ ID NO: 435 - protein, 40 aa, Artificial Sequence
  Description of Artificial Sequence: Synthetic polypeptide
IHRDLKSNNIFLHEDLTVKIGDFSLATVKSRWSGSHQFEQ

SEQ ID NO: 436 - protein, 40 aa, Artificial Sequence
  Description of Artificial Sequence: Synthetic polypeptide
HRDLKSNNIFLHEDLTVKIGDFSLATVKSRWSGSHQFEQL

SEQ ID NO: 437 - protein, 40 aa, Artificial Sequence
  Description of Artificial Sequence: Synthetic polypeptide
RDLKSNNIFLHEDLTVKIGDFSLATVKSRWSGSHQFEQLS

SEQ ID NO: 438 - protein, 40 aa, Artificial Sequence
  Description of Artificial Sequence: Synthetic polypeptide
KSNNIFLHEDLTVKIGDFSLATVKSRWSGSHQFEQLSGSI

SEQ ID NO: 439 - protein, 40 aa, Artificial Sequence
  Description of Artificial Sequence: Synthetic polypeptide
SNNIFLHEDLTVKIGDFSLATVKSRWSGSHQFEQLSGSIL

SEQ ID NO: 440 - protein, 40 aa, Artificial Sequence
  Description of Artificial Sequence: Synthetic polypeptide
NNIFLHEDLTVKIGDFSLATVKSRWSGSHQFEQLSGSILW

SEQ ID NO: 441 - protein, 40 aa, Artificial Sequence
  Description of Artificial Sequence: Synthetic polypeptide
FLHEDLTVKIGDFSLATVKSRWSGSHQFEQLSGSILWMAP

SEQ ID NO: 442 - protein, 40 aa, Artificial Sequence
  Description of Artificial Sequence: Synthetic polypeptide
QTAQGMDYLHAKSIIHRDLKSNNIFLHEDLTVKIGDFGQA

SEQ ID NO: 443 - protein, 40 aa, Artificial Sequence
  Description of Artificial Sequence: Synthetic polypeptide
TAQGMDYLHAKSIIHRDLKSNNIFLHEDLTVKIGDFGQAT

SEQ ID NO: 444 - protein, 40 aa, Artificial Sequence
  Description of Artificial Sequence: Synthetic polypeptide
MDYLHAKSIIHRDLKSNNIFLHEDLTVKIGDFGQATVKSR

SEQ ID NO: 445 - protein, 40 aa, Artificial Sequence
  Description of Artificial Sequence: Synthetic polypeptide
DYLHAKSIIHRDLKSNNIFLHEDLTVKIGDFGQATVKSRW

SEQ ID NO: 446 - protein, 40 aa, Artificial Sequence
  Description of Artificial Sequence: Synthetic polypeptide
AKSIIHRDLKSNNIFLHEDLTVKIGDFGQATVKSRWSGSH

SEQ ID NO: 447 - protein, 40 aa, Artificial Sequence
  Description of Artificial Sequence: Synthetic polypeptide
KSIIHRDLKSNNIFLHEDLTVKIGDFGQATVKSRWSGSHQ

SEQ ID NO: 448 - protein, 40 aa, Artificial Sequence
  Description of Artificial Sequence: Synthetic polypeptide
SIIHRDLKSNNIFLHEDLTVKIGDFGQATVKSRWSGSHQF

SEQ ID NO: 449 - protein, 40 aa, Artificial Sequence
  Description of Artificial Sequence: Synthetic polypeptide
IIHRDLKSNNIFLHEDLTVKIGDFGQATVKSRWSGSHQFE

SEQ ID NO: 450 - protein, 40 aa, Artificial Sequence
  Description of Artificial Sequence: Synthetic polypeptide
IHRDLKSNNIFLHEDLTVKIGDFGQATVKSRWSGSHQFEQ

SEQ ID NO: 451 - protein, 40 aa, Artificial Sequence
  Description of Artificial Sequence: Synthetic polypeptide
RDLKSNNIFLHEDLTVKIGDFGQATVKSRWSGSHQFEQLS

SEQ ID NO: 452 - protein, 40 aa, Artificial Sequence
  Description of Artificial Sequence: Synthetic polypeptide
DLKSNNIFLHEDLTVKIGDFGQATVKSRWSGSHQFEQLSG

SEQ ID NO: 453 - protein, 40 aa, Artificial Sequence
  Description of Artificial Sequence: Synthetic polypeptide
KSNNIFLHEDLTVKIGDFGQATVKSRWSGSHQFEQLSGSI

SEQ ID NO: 454 - protein, 40 aa, Artificial Sequence
  Description of Artificial Sequence: Synthetic polypeptide
SNNIFLHEDLTVKIGDFGQATVKSRWSGSHQFEQLSGSIL

SEQ ID NO: 455 - protein, 40 aa, Artificial Sequence
  Description of Artificial Sequence: Synthetic polypeptide
NNIFLHEDLTVKIGDFGQATVKSRWSGSHQFEQLSGSILW

SEQ ID NO: 456 - protein, 40 aa, Artificial Sequence
  Description of Artificial Sequence: Synthetic polypeptide
FLHEDLTVKIGDFGQATVKSRWSGSHQFEQLSGSILWMAP

SEQ ID NO: 457 - protein, 40 aa, Artificial Sequence
  Description of Artificial Sequence: Synthetic polypeptide
IGDFGQATVKSRWSGSHQFEQLSGSILWMAPEVIRMQDKN

SEQ ID NO: 458 - protein, 40 aa, Artificial Sequence
  Description of Artificial Sequence: Synthetic polypeptide
TAQGMDYLHAKSIIHRDLKSNNIFLHEDLTVKIGDFGVAT

SEQ ID NO: 459 - protein, 40 aa, Artificial Sequence
  Description of Artificial Sequence: Synthetic polypeptide
AQGMDYLHAKSIIHRDLKSNNIFLHEDLTVKIGDFGVATV

SEQ ID NO: 460 - protein, 40 aa, Artificial Sequence
  Description of Artificial Sequence: Synthetic polypeptide
QGMDYLHAKSIIHRDLKSNNIFLHEDLTVKIGDFGVATVK

SEQ ID NO: 461 - protein, 40 aa, Artificial Sequence
  Description of Artificial Sequence: Synthetic polypeptide
GMDYLHAKSIIHRDLKSNNIFLHEDLTVKIGDFGVATVKS

SEQ ID NO: 462 - protein, 40 aa, Artificial Sequence
  Description of Artificial Sequence: Synthetic polypeptide
MDYLHAKSIIHRDLKSNNIFLHEDLTVKIGDFGVATVKSR

SEQ ID NO: 463 - protein, 40 aa, Artificial Sequence
  Description of Artificial Sequence: Synthetic polypeptide
DYLHAKSIIHRDLKSNNIFLHEDLTVKIGDFGVATVKSRW

SEQ ID NO: 464 - protein, 40 aa, Artificial Sequence
  Description of Artificial Sequence: Synthetic polypeptide
AKSIIHRDLKSNNIFLHEDLTVKIGDFGVATVKSRWSGSH

SEQ ID NO: 465 - protein, 40 aa, Artificial Sequence
  Description of Artificial Sequence: Synthetic polypeptide
KSIIHRDLKSNNIFLHEDLTVKIGDFGVATVKSRWSGSHQ

SEQ ID NO: 466 - protein, 40 aa, Artificial Sequence
  Description of Artificial Sequence: Synthetic polypeptide
SIIHRDLKSNNIFLHEDLTVKIGDFGVATVKSRWSGSHQF

SEQ ID NO: 467 - protein, 40 aa, Artificial Sequence
  Description of Artificial Sequence: Synthetic polypeptide
IIHRDLKSNNIFLHEDLTVKIGDFGVATVKSRWSGSHQFE

SEQ ID NO: 468 - protein, 40 aa, Artificial Sequence
  Description of Artificial Sequence: Synthetic polypeptide
IHRDLKSNNIFLHEDLTVKIGDFGVATVKSRWSGSHQFEQ

SEQ ID NO: 469 - protein, 40 aa, Artificial Sequence
  Description of Artificial Sequence: Synthetic polypeptide
HRDLKSNNIFLHEDLTVKIGDFGVATVKSRWSGSHQFEQL

SEQ ID NO: 470 - protein, 40 aa, Artificial Sequence
  Description of Artificial Sequence: Synthetic polypeptide
RDLKSNNIFLHEDLTVKIGDFGVATVKSRWSGSHQFEQLS

SEQ ID NO: 471 - protein, 40 aa, Artificial Sequence
  Description of Artificial Sequence: Synthetic polypeptide
SNNIFLHEDLTVKIGDFGVATVKSRWSGSHQFEQLSGSIL

SEQ ID NO: 472 - protein, 40 aa, Artificial Sequence
  Description of Artificial Sequence: Synthetic polypeptide
NNIFLHEDLTVKIGDFGVATVKSRWSGSHQFEQLSGSILW

SEQ ID NO: 473 - protein, 40 aa, Artificial Sequence
  Description of Artificial Sequence: Synthetic polypeptide
TVKIGDFGVATVKSRWSGSHQFEQLSGSILWMAPEVIRMQ

SEQ ID NO: 474 - protein, 40 aa, Artificial Sequence
  Description of Artificial Sequence: Synthetic polypeptide
QGMDYLHAKSIIHRDLKSNNIFLHEDLTVKIGDFGLATEK

SEQ ID NO: 475 - protein, 40 aa, Artificial Sequence
  Description of Artificial Sequence: Synthetic polypeptide
DYLHAKSIIHRDLKSNNIFLHEDLTVKIGDFGLATEKSRW

SEQ ID NO: 476 - protein, 40 aa, Artificial Sequence
  Description of Artificial Sequence: Synthetic polypeptide
YLHAKSIIHRDLKSNNIFLHEDLTVKIGDFGLATEKSRWS

SEQ ID NO: 477 - protein, 40 aa, Artificial Sequence
  Description of Artificial Sequence: Synthetic polypeptide
LHAKSIIHRDLKSNNIFLHEDLTVKIGDFGLATEKSRWSG

SEQ ID NO: 478 - protein, 40 aa, Artificial Sequence
  Description of Artificial Sequence: Synthetic polypeptide
AKSIIHRDLKSNNIFLHEDLTVKIGDFGLATEKSRWSGSH

SEQ ID NO: 479 - protein, 40 aa, Artificial Sequence
  Description of Artificial Sequence: Synthetic polypeptide
KSIIHRDLKSNNIFLHEDLTVKIGDFGLATEKSRWSGSHQ

SEQ ID NO: 480 - protein, 40 aa, Artificial Sequence
  Description of Artificial Sequence: Synthetic polypeptide
SIIHRDLKSNNIFLHEDLTVKIGDFGLATEKSRWSGSHQF

SEQ ID NO: 481 - protein, 40 aa, Artificial Sequence
  Description of Artificial Sequence: Synthetic polypeptide
IIHRDLKSNNIFLHEDLTVKIGDFGLATEKSRWSGSHQFE

SEQ ID NO: 482 - protein, 40 aa, Artificial Sequence
  Description of Artificial Sequence: Synthetic polypeptide
IHRDLKSNNIFLHEDLTVKIGDFGLATEKSRWSGSHQFEQ

SEQ ID NO: 483 - protein, 40 aa, Artificial Sequence
  Description of Artificial Sequence: Synthetic polypeptide
HRDLKSNNIFLHEDLTVKIGDFGLATEKSRWSGSHQFEQL

SEQ ID NO: 484 - protein, 40 aa, Artificial Sequence
  Description of Artificial Sequence: Synthetic polypeptide
RDLKSNNIFLHEDLTVKIGDFGLATEKSRWSGSHQFEQLS

SEQ ID NO: 485 - protein, 40 aa, Artificial Sequence
  Description of Artificial Sequence: Synthetic polypeptide
LKSNNIFLHEDLTVKIGDFGLATEKSRWSGSHQFEQLSGS

SEQ ID NO: 486 - protein, 40 aa, Artificial Sequence
  Description of Artificial Sequence: Synthetic polypeptide
KSNNIFLHEDLTVKIGDFGLATEKSRWSGSHQFEQLSGSI

SEQ ID NO: 487 - protein, 40 aa, Artificial Sequence
  Description of Artificial Sequence: Synthetic polypeptide
SNNIFLHEDLTVKIGDFGLATEKSRWSGSHQFEQLSGSIL

SEQ ID NO: 488 - protein, 40 aa, Artificial Sequence
  Description of Artificial Sequence: Synthetic polypeptide
NNIFLHEDLTVKIGDFGLATEKSRWSGSHQFEQLSGSILW

SEQ ID NO: 489 - protein, 40 aa, Artificial Sequence
  Description of Artificial Sequence: Synthetic polypeptide
TEKSRWSGSHQFEQLSGSILWMAPEVIRMQDKNPYSFQSD

SEQ ID NO: 490 - protein, 40 aa, Artificial Sequence
  Description of Artificial Sequence: Synthetic polypeptide
EAPIYELTSQFTGLKCPSLAGKPKVFFIQACQGDNYQKGI

SEQ ID NO: 491 - protein, 40 aa, Artificial Sequence
  Description of Artificial Sequence: Synthetic polypeptide
KCPSLAGKPKVFFIQACQGDNYQKGIPVETDSEEQPYLEM

SEQ ID NO: 492 - protein, 40 aa, Artificial Sequence
  Description of Artificial Sequence: Synthetic polypeptide
QACQGDNYQKGIPVETDSEEQPYLEMDLSSPQTRYIPDEA

SEQ ID NO: 493 - protein, 40 aa, Artificial Sequence
  Description of Artificial Sequence: Synthetic polypeptide
EAPIYELTSQFTGLKCPSLAGKPKVFFIQACQGDNYQGGI

SEQ ID NO: 494 - protein, 40 aa, Artificial Sequence
  Description of Artificial Sequence: Synthetic polypeptide
LTSQFTGLKCPSLAGKPKVFFIQACQGDNYQGGIPVETDS

SEQ ID NO: 495 - protein, 40 aa, Artificial Sequence
  Description of Artificial Sequence: Synthetic polypeptide
LAGKPKVFFIQACQGDNYQGGIPVETDSEEQPYLEMDLSS

SEQ ID NO: 496 - protein, 40 aa, Artificial Sequence
  Description of Artificial Sequence: Synthetic polypeptide
GKPKVFFIQACQGDNYQGGIPVETDSEEQPYLEMDLSSPQ

SEQ ID NO: 497 - protein, 40 aa, Artificial Sequence
  Description of Artificial Sequence: Synthetic polypeptide
PKVFFIQACQGDNYQGGIPVETDSEEQPYLEMDLSSPQTR

SEQ ID NO: 498 - protein, 40 aa, Artificial Sequence
  Description of Artificial Sequence: Synthetic polypeptide
CQGDNYQGGIPVETDSEEQPYLEMDLSSPQTRYIPDEADF

SEQ ID NO: 499 - protein, 40 aa, Artificial Sequence
  Description of Artificial Sequence: Synthetic polypeptide
PLDGERIATYTLFSHAVSSNGNAVEDPMEILITVTDQNDN

SEQ ID NO: 500 - protein, 40 aa, Artificial Sequence
  Description of Artificial Sequence: Synthetic polypeptide
EPLDRERIATYTLFSHAVSSNGNAVEDPMEILITVTDQNG

SEQ ID NO: 501 - protein, 40 aa, Artificial Sequence
  Description of Artificial Sequence: Synthetic polypeptide
DRERIATYTLFSHAVSSNGNAVEDPMEILITVTDQNGNKP

SEQ ID NO: 502 - protein, 40 aa, Artificial Sequence
  Description of Artificial Sequence: Synthetic polypeptide
IATYTLFSHAVSSNGNAVEDPMEILITVTDQNGNKPEFTQ

SEQ ID NO: 503 - protein, 40 aa, Artificial Sequence
  Description of Artificial Sequence: Synthetic polypeptide
TYTLFSHAVSSNGNAVEDPMEILITVTDQNGNKPEFTQEV

SEQ ID NO: 504 - protein, 40 aa, Artificial Sequence
  Description of Artificial Sequence: Synthetic polypeptide
VSSNGNAVEDPMEILITVTDQNGNKPEFTQEVFKGSVMEG

SEQ ID NO: 505 - protein, 40 aa, Artificial Sequence
  Description of Artificial Sequence: Synthetic polypeptide
GNAVEDPMEILITVTDQNGNKPEFTQEVFKGSVMEGALPG

SEQ ID NO: 506 - protein, 40 aa, Artificial Sequence
  Description of Artificial Sequence: Synthetic polypeptide
AVEDPMEILITVTDQNGNKPEFTQEVFKGSVMEGALPGTS

SEQ ID NO: 507 - protein, 40 aa, Artificial Sequence
  Description of Artificial Sequence: Synthetic polypeptide
ITVTDQNGNKPEFTQEVFKGSVMEGALPGTSVMEVTATDA

SEQ ID NO: 508 - protein, 40 aa, Artificial Sequence
  Description of Artificial Sequence: Synthetic polypeptide
DRERIATYTLFSHAVSSNGNAVEDPMEILITVTDQNNNKP

SEQ ID NO: 509 - protein, 40 aa, Artificial Sequence
  Description of Artificial Sequence: Synthetic polypeptide
ERIATYTLFSHAVSSNGNAVEDPMEILITVTDQNNNKPEF

SEQ ID NO: 510 - protein, 40 aa, Artificial Sequence
  Description of Artificial Sequence: Synthetic polypeptide
TLFSHAVSSNGNAVEDPMEILITVTDQNNNKPEFTQEVFK

SEQ ID NO: 511 - protein, 40 aa, Artificial Sequence
  Description of Artificial Sequence: Synthetic polypeptide
SHAVSSNGNAVEDPMEILITVTDQNNNKPEFTQEVFKGSV

SEQ ID NO: 512 - protein, 40 aa, Artificial Sequence
  Description of Artificial Sequence: Synthetic polypeptide
DQNNNKPEFTQEVFKGSVMEGALPGTSVMEVTATDADDDV

SEQ ID NO: 513 - protein, 40 aa, Artificial Sequence
  Description of Artificial Sequence: Synthetic polypeptide
TVTDQNDNKPEFTQEVFKGSVMEGALPGTSVMEVTATDAG

SEQ ID NO: 514 - protein, 40 aa, Artificial Sequence
  Description of Artificial Sequence: Synthetic polypeptide
FTQEVFKGSVMEGALPGTSVMEVTATDAGDDVNTYNAAIA

SEQ ID NO: 515 - protein, 40 aa, Artificial Sequence
  Description of Artificial Sequence: Synthetic polypeptide
RLPVDLTEELGHRDVARYLRAAAGGTRGSNHARIDAAEGP

SEQ ID NO: 516 - protein, 40 aa, Artificial Sequence
  Description of Artificial Sequence: Synthetic polypeptide
RRPIQVMMMGSARVAELLLLHGAEPNCADPATLTRPVHYA

SEQ ID NO: 517 - protein, 40 aa, Artificial Sequence
  Description of Artificial Sequence: Synthetic polypeptide
LLHGAEPNCADPATLTRPVHYAAREGFLDTLVVLHRAGAR

SEQ ID NO: 518 - protein, 40 aa, Artificial Sequence
  Description of Artificial Sequence: Synthetic polypeptide
SQEEDCLIKITDFGHSKILGETSLRRTLCGTPTYLAPEVL

SEQ ID NO: 519 - protein, 40 aa, Artificial Sequence
  Description of Artificial Sequence: Synthetic polypeptide
EEDCLIKITDFGHSKILGETSLRRTLCGTPTYLAPEVLVS

SEQ ID NO: 520 - protein, 40 aa, Artificial Sequence
  Description of Artificial Sequence: Synthetic polypeptide
EDCLIKITDFGHSKILGETSLRRTLCGTPTYLAPEVLVSV

SEQ ID NO: 521 - protein, 40 aa, Artificial Sequence
  Description of Artificial Sequence: Synthetic polypeptide
IKITDFGHSKILGETSLRRTLCGTPTYLAPEVLVSVGTAG

SEQ ID NO: 522 - protein, 40 aa, Artificial Sequence
  Description of Artificial Sequence: Synthetic polypeptide
LRRTLCGTPTYLAPEVLVSVGTAGYNRAVDCWSLGVILFI

SEQ ID NO: 523 - protein, 40 aa, Artificial Sequence
  Description of Artificial Sequence: Synthetic polypeptide
RRTLCGTPTYLAPEVLVSVGTAGYNRAVDCWSLGVILFIC

SEQ ID NO: 524 - protein, 40 aa, Artificial Sequence
  Description of Artificial Sequence: Synthetic polypeptide
LSSQEEDCLIKITDFGHSKILGETSLMRTLCGTLTYLAPE

SEQ ID NO: 525 - protein, 40 aa, Artificial Sequence
  Description of Artificial Sequence: Synthetic polypeptide
EEDCLIKITDFGHSKILGETSLMRTLCGTLTYLAPEVLVS

SEQ ID NO: 526 - protein, 40 aa, Artificial Sequence
  Description of Artificial Sequence: Synthetic polypeptide
EDCLIKITDFGHSKILGETSLMRTLCGTLTYLAPEVLVSV

SEQ ID NO: 527 - protein, 40 aa, Artificial Sequence
  Description of Artificial Sequence: Synthetic polypeptide
DCLIKITDFGHSKILGETSLMRTLCGTLTYLAPEVLVSVG

SEQ ID NO: 528 - protein, 40 aa, Artificial Sequence
  Description of Artificial Sequence: Synthetic polypeptide
CLIKITDFGHSKILGETSLMRTLCGTLTYLAPEVLVSVGT

SEQ ID NO: 529 - protein, 40 aa, Artificial Sequence
  Description of Artificial Sequence: Synthetic polypeptide
LIKITDFGHSKILGETSLMRTLCGTLTYLAPEVLVSVGTA

SEQ ID NO: 530 - protein, 40 aa, Artificial Sequence
  Description of Artificial Sequence: Synthetic polypeptide
ITDFGHSKILGETSLMRTLCGTLTYLAPEVLVSVGTAGYN

SEQ ID NO: 531 - protein, 40 aa, Artificial Sequence
  Description of Artificial Sequence: Synthetic polypeptide
DFGHSKILGETSLMRTLCGTLTYLAPEVLVSVGTAGYNRA

SEQ ID NO: 532 - protein, 40 aa, Artificial Sequence
  Description of Artificial Sequence: Synthetic polypeptide
TSLMRTLCGTLTYLAPEVLVSVGTAGYNRAVDCWSLGVIL

SEQ ID NO: 533 - protein, 40 aa, Artificial Sequence
  Description of Artificial Sequence: Synthetic polypeptide
LMRTLCGTLTYLAPEVLVSVGTAGYNRAVDCWSLGVILFI

SEQ ID NO: 534 - protein, 40 aa, Artificial Sequence
  Description of Artificial Sequence: Synthetic polypeptide
MRTLCGTLTYLAPEVLVSVGTAGYNRAVDCWSLGVILFIC

SEQ ID NO: 535 - protein, 40 aa, Artificial Sequence
  Description of Artificial Sequence: Synthetic polypeptide
TLCGTLTYLAPEVLVSVGTAGYNRAVDCWSLGVILFICLS

SEQ ID NO: 536 - protein, 40 aa, Artificial Sequence
  Description of Artificial Sequence: Synthetic polypeptide
LCGTLTYLAPEVLVSVGTAGYNRAVDCWSLGVILFICLSG

SEQ ID NO: 537 - protein, 40 aa, Artificial Sequence
  Description of Artificial Sequence: Synthetic polypeptide
GTLTYLAPEVLVSVGTAGYNRAVDCWSLGVILFICLSGYP

SEQ ID NO: 538 - protein, 40 aa, Artificial Sequence
  Description of Artificial Sequence: Synthetic polypeptide
LTYLAPEVLVSVGTAGYNRAVDCWSLGVILFICLSGYPPF

SEQ ID NO: 539 - protein, 40 aa, Artificial Sequence
  Description of Artificial Sequence: Synthetic polypeptide
SQEEDCLIKITDFGHSKILGETSLMRTLCGTYTYLAPEVL

SEQ ID NO: 540 - protein, 40 aa, Artificial Sequence
  Description of Artificial Sequence: Synthetic polypeptide
QEEDCLIKITDFGHSKILGETSLMRTLCGTYTYLAPEVLV

SEQ ID NO: 541 - protein, 40 aa, Artificial Sequence
  Description of Artificial Sequence: Synthetic polypeptide
EEDCLIKITDFGHSKILGETSLMRTLCGTYTYLAPEVLVS

SEQ ID NO: 542 - protein, 40 aa, Artificial Sequence
  Description of Artificial Sequence: Synthetic polypeptide
EDCLIKITDFGHSKILGETSLMRTLCGTYTYLAPEVLVSV

SEQ ID NO: 543 - protein, 40 aa, Artificial Sequence
  Description of Artificial Sequence: Synthetic polypeptide
CLIKITDFGHSKILGETSLMRTLCGTYTYLAPEVLVSVGT

SEQ ID NO: 544 - protein, 40 aa, Artificial Sequence
  Description of Artificial Sequence: Synthetic polypeptide
DFGHSKILGETSLMRTLCGTYTYLAPEVLVSVGTAGYNRA

SEQ ID NO: 545 - protein, 40 aa, Artificial Sequence
  Description of Artificial Sequence: Synthetic polypeptide
SLMRTLCGTYTYLAPEVLVSVGTAGYNRAVDCWSLGVILF

SEQ ID NO: 546 - protein, 40 aa, Artificial Sequence
  Description of Artificial Sequence: Synthetic polypeptide
LMRTLCGTYTYLAPEVLVSVGTAGYNRAVDCWSLGVILFI

SEQ ID NO: 547 - protein, 40 aa, Artificial Sequence
  Description of Artificial Sequence: Synthetic polypeptide
RTLCGTYTYLAPEVLVSVGTAGYNRAVDCWSLGVILFICL

SEQ ID NO: 548 - protein, 40 aa, Artificial Sequence
  Description of Artificial Sequence: Synthetic polypeptide
TLCGTYTYLAPEVLVSVGTAGYNRAVDCWSLGVILFICLS

SEQ ID NO: 549 - protein, 40 aa, Artificial Sequence
  Description of Artificial Sequence: Synthetic polypeptide
LCGTYTYLAPEVLVSVGTAGYNRAVDCWSLGVILFICLSG

SEQ ID NO: 550 - protein, 40 aa, Artificial Sequence
  Description of Artificial Sequence: Synthetic polypeptide
GTYTYLAPEVLVSVGTAGYNRAVDCWSLGVILFICLSGYP

SEQ ID NO: 551 - protein, 40 aa, Artificial Sequence
  Description of Artificial Sequence: Synthetic polypeptide
YTYLAPEVLVSVGTAGYNRAVDCWSLGVILFICLSGYPPF

SEQ ID NO: 552 - protein, 40 aa, Artificial Sequence
  Description of Artificial Sequence: Synthetic polypeptide
ENVLLSSQEEDCLIKITDFGHSKILGETSLMRTLCGTPHY

SEQ ID NO: 553 - protein, 40 aa, Artificial Sequence
  Description of Artificial Sequence: Synthetic polypeptide
LSSQEEDCLIKITDFGHSKILGETSLMRTLCGTPHYLAPE

SEQ ID NO: 554 - protein, 40 aa, Artificial Sequence
  Description of Artificial Sequence: Synthetic polypeptide
SQEEDCLIKITDFGHSKILGETSLMRTLCGTPHYLAPEVL

SEQ ID NO: 555 - protein, 40 aa, Artificial Sequence
  Description of Artificial Sequence: Synthetic polypeptide
QEEDCLIKITDFGHSKILGETSLMRTLCGTPHYLAPEVLV

SEQ ID NO: 556 - protein, 40 aa, Artificial Sequence
  Description of Artificial Sequence: Synthetic polypeptide
EEDCLIKITDFGHSKILGETSLMRTLCGTPHYLAPEVLVS

SEQ ID NO: 557 - protein, 40 aa, Artificial Sequence
  Description of Artificial Sequence: Synthetic polypeptide
EDCLIKITDFGHSKILGETSLMRTLCGTPHYLAPEVLVSV

SEQ ID NO: 558 - protein, 40 aa, Artificial Sequence
  Description of Artificial Sequence: Synthetic polypeptide
DCLIKITDFGHSKILGETSLMRTLCGTPHYLAPEVLVSVG

SEQ ID NO: 559 - protein, 40 aa, Artificial Sequence
  Description of Artificial Sequence: Synthetic polypeptide
CLIKITDFGHSKILGETSLMRTLCGTPHYLAPEVLVSVGT

SEQ ID NO: 560 - protein, 40 aa, Artificial Sequence
  Description of Artificial Sequence: Synthetic polypeptide
IKITDFGHSKILGETSLMRTLCGTPHYLAPEVLVSVGTAG

SEQ ID NO: 561 - protein, 40 aa, Artificial Sequence
  Description of Artificial Sequence: Synthetic polypeptide
TSLMRTLCGTPHYLAPEVLVSVGTAGYNRAVDCWSLGVIL

SEQ ID NO: 562 - protein, 40 aa, Artificial Sequence
  Description of Artificial Sequence: Synthetic polypeptide
SLMRTLCGTPHYLAPEVLVSVGTAGYNRAVDCWSLGVILF

SEQ ID NO: 563 - protein, 40 aa, Artificial Sequence
  Description of Artificial Sequence: Synthetic polypeptide
RTLCGTPHYLAPEVLVSVGTAGYNRAVDCWSLGVILFICL

SEQ ID NO: 564 - protein, 40 aa, Artificial Sequence
  Description of Artificial Sequence: Synthetic polypeptide
TLCGTPHYLAPEVLVSVGTAGYNRAVDCWSLGVILFICLS

SEQ ID NO: 565 - protein, 40 aa, Artificial Sequence
  Description of Artificial Sequence: Synthetic polypeptide
LCGTPHYLAPEVLVSVGTAGYNRAVDCWSLGVILFICLSG

SEQ ID NO: 566 - protein, 40 aa, Artificial Sequence
  Description of Artificial Sequence: Synthetic polypeptide
CGTPHYLAPEVLVSVGTAGYNRAVDCWSLGVILFICLSGY

SEQ ID NO: 567 - protein, 40 aa, Artificial Sequence
  Description of Artificial Sequence: Synthetic polypeptide
GTPHYLAPEVLVSVGTAGYNRAVDCWSLGVILFICLSGYP

SEQ ID NO: 568 - protein, 40 aa, Artificial Sequence
  Description of Artificial Sequence: Synthetic polypeptide
TPHYLAPEVLVSVGTAGYNRAVDCWSLGVILFICLSGYPP

SEQ ID NO: 569 - protein, 40 aa, Artificial Sequence
  Description of Artificial Sequence: Synthetic polypeptide
PHYLAPEVLVSVGTAGYNRAVDCWSLGVILFICLSGYPPF

SEQ ID NO: 570 - protein, 40 aa, Artificial Sequence
  Description of Artificial Sequence: Synthetic polypeptide
HYLAPEVLVSVGTAGYNRAVDCWSLGVILFICLSGYPPFS

SEQ ID NO: 571 - protein, 40 aa, Artificial Sequence
  Description of Artificial Sequence: Synthetic polypeptide
SLMRTLCGTPTYLAPEVLVSVGTAGYNRAVDCWSLGFILF

SEQ ID NO: 572 - protein, 40 aa, Artificial Sequence
  Description of Artificial Sequence: Synthetic polypeptide
LMRTLCGTPTYLAPEVLVSVGTAGYNRAVDCWSLGFILFI

SEQ ID NO: 573 - protein, 40 aa, Artificial Sequence
  Description of Artificial Sequence: Synthetic polypeptide
MRTLCGTPTYLAPEVLVSVGTAGYNRAVDCWSLGFILFIC

SEQ ID NO: 574 - protein, 40 aa, Artificial Sequence
  Description of Artificial Sequence: Synthetic polypeptide
TLCGTPTYLAPEVLVSVGTAGYNRAVDCWSLGFILFICLS

SEQ ID NO: 575 - protein, 40 aa, Artificial Sequence
  Description of Artificial Sequence: Synthetic polypeptide
LCGTPTYLAPEVLVSVGTAGYNRAVDCWSLGFILFICLSG

SEQ ID NO: 576 - protein, 40 aa, Artificial Sequence
  Description of Artificial Sequence: Synthetic polypeptide
CGTPTYLAPEVLVSVGTAGYNRAVDCWSLGFILFICLSGY

SEQ ID NO: 577 - protein, 40 aa, Artificial Sequence
  Description of Artificial Sequence: Synthetic polypeptide
GTPTYLAPEVLVSVGTAGYNRAVDCWSLGFILFICLSGYP

SEQ ID NO: 578 - protein, 40 aa, Artificial Sequence
  Description of Artificial Sequence: Synthetic polypeptide
PTYLAPEVLVSVGTAGYNRAVDCWSLGFILFICLSGYPPF

SEQ ID NO: 579 - protein, 40 aa, Artificial Sequence
  Description of Artificial Sequence: Synthetic polypeptide
YLAPEVLVSVGTAGYNRAVDCWSLGFILFICLSGYPPFSE

SEQ ID NO: 580 - protein, 40 aa, Artificial Sequence
  Description of Artificial Sequence: Synthetic polypeptide
LAPEVLVSVGTAGYNRAVDCWSLGFILFICLSGYPPFSEH

SEQ ID NO: 581 - protein, 40 aa, Artificial Sequence
  Description of Artificial Sequence: Synthetic polypeptide
APEVLVSVGTAGYNRAVDCWSLGFILFICLSGYPPFSEHR

SEQ ID NO: 582 - protein, 40 aa, Artificial Sequence
  Description of Artificial Sequence: Synthetic polypeptide
PEVLVSVGTAGYNRAVDCWSLGFILFICLSGYPPFSEHRT

SEQ ID NO: 583 - protein, 40 aa, Artificial Sequence
  Description of Artificial Sequence: Synthetic polypeptide
EVLVSVGTAGYNRAVDCWSLGFILFICLSGYPPFSEHRTQ

SEQ ID NO: 584 - protein, 40 aa, Artificial Sequence
  Description of Artificial Sequence: Synthetic polypeptide
LVSVGTAGYNRAVDCWSLGFILFICLSGYPPFSEHRTQVS

SEQ ID NO: 585 - protein, 40 aa, Artificial Sequence
  Description of Artificial Sequence: Synthetic polypeptide
GTAGYNRAVDCWSLGFILFICLSGYPPFSEHRTQVSLKDQ

SEQ ID NO: 586 - protein, 40 aa, Artificial Sequence
  Description of Artificial Sequence: Synthetic polypeptide
SLGFILFICLSGYPPFSEHRTQVSLKDQITSGKYNFIPEV

SEQ ID NO: 587 - protein, 40 aa, Artificial Sequence
  Description of Artificial Sequence: Synthetic polypeptide
FICLSGYPPFSEHRTQVSLKDQITSGKYNFIPEVGAEVSE

SEQ ID NO: 588 - protein, 40 aa, Artificial Sequence
  Description of Artificial Sequence: Synthetic polypeptide
EHRTQVSLKDQITSGKYNFIPEVGAEVSEKALDLVKKLLV

SEQ ID NO: 589 - protein, 40 aa, Artificial Sequence
  Description of Artificial Sequence: Synthetic polypeptide
TSGKYNFIPEVGAEVSEKALDLVKKLLVVDPKARFTTEEA

SEQ ID NO: 590 - protein, 40 aa, Artificial Sequence
  Description of Artificial Sequence: Synthetic polypeptide
YNFIPEVGAEVSEKALDLVKKLLVVDPKARFTTEEALRHP

SEQ ID NO: 591 - protein, 40 aa, Artificial Sequence
  Description of Artificial Sequence: Synthetic polypeptide
NFIPEVGAEVSEKALDLVKKLLVVDPKARFTTEEALRHPW

SEQ ID NO: 592 - protein, 40 aa, Artificial Sequence
  Description of Artificial Sequence: Synthetic polypeptide
PEVGAEVSEKALDLVKKLLVVDPKARFTTEEALRHPWLQD

SEQ ID NO: 593 - protein, 40 aa, Artificial Sequence
  Description of Artificial Sequence: Synthetic polypeptide
MATQADLMELDMAMEPDRKAAVSHWQQQSYLVSGIHSGAT

SEQ ID NO: 594 - protein, 40 aa, Artificial Sequence
  Description of Artificial Sequence: Synthetic polypeptide
QADLMELDMAMEPDRKAAVSHWQQQSYLYSGIHSGATTTA

SEQ ID NO: 595 - protein, 40 aa, Artificial Sequence
  Description of Artificial Sequence: Synthetic polypeptide
ITTDCLQILAYGNQESKLIILASGGPQALVNIMRTYTFEK

SEQ ID NO: 596 - protein, 40 aa, Artificial Sequence
  Description of Artificial Sequence: Synthetic polypeptide
TTDCLQILAYGNQESKLIILASGGPQALVNIMRTYTFEKL

SEQ ID NO: 597 - protein, 40 aa, Artificial Sequence
  Description of Artificial Sequence: Synthetic polypeptide
TDCLQILAYGNQESKLIILASGGPQALVNIMRTYTFEKLL

SEQ ID NO: 598 - protein, 40 aa, Artificial Sequence
  Description of Artificial Sequence: Synthetic polypeptide
DCLQILAYGNQESKLIILASGGPQALVNIMRTYTFEKLLW

SEQ ID NO: 599 - protein, 40 aa, Artificial Sequence
  Description of Artificial Sequence: Synthetic polypeptide
ESKLIILASGGPQALVNIMRTYTFEKLLWTTSRVLKVLSV

SEQ ID NO: 600 - protein, 40 aa, Artificial Sequence
  Description of Artificial Sequence: Synthetic polypeptide
GPQALVNIMRTYTFEKLLWTTSRVLKVLSVCSSNKPAIVE

SEQ ID NO: 601 - protein, 40 aa, Artificial Sequence
  Description of Artificial Sequence: Synthetic polypeptide
PQALVNIMRTYTFEKLLWTTSRVLKVLSVCSSNKPAIVEA

SEQ ID NO: 602 - protein, 40 aa, Artificial Sequence
  Description of Artificial Sequence: Synthetic polypeptide
TTDCLQILAYGNQESKLIILASGGPQALVNIMRTYTYKKL

SEQ ID NO: 603 - protein, 40 aa, Artificial Sequence
  Description of Artificial Sequence: Synthetic polypeptide
TDCLQILAYGNQESKLIILASGGPQALVNIMRTYTYKKLL

SEQ ID NO: 604 - protein, 40 aa, Artificial Sequence
  Description of Artificial Sequence: Synthetic polypeptide
DCLQILAYGNQESKLIILASGGPQALVNIMRTYTYKKLLW

SEQ ID NO: 605 - protein, 40 aa, Artificial Sequence
  Description of Artificial Sequence: Synthetic polypeptide
QILAYGNQESKLIILASGGPQALVNIMRTYTYKKLLWTTS

SEQ ID NO: 606 - protein, 40 aa, Artificial Sequence
  Description of Artificial Sequence: Synthetic polypeptide
ITTDCLQILAYGNQESKLIILASGGPQALVNIMRTYTYET

SEQ ID NO: 607 - protein, 40 aa, Artificial Sequence
  Description of Artificial Sequence: Synthetic polypeptide
TTDCLQILAYGNQESKLIILASGGPQALVNIMRTYTYETL

SEQ ID NO: 608 - protein, 40 aa, Artificial Sequence
  Description of Artificial Sequence: Synthetic polypeptide
LQILAYGNQESKLIILASGGPQALVNIMRTYTYETLLWTT

SEQ ID NO: 609 - protein, 40 aa, Artificial Sequence
  Description of Artificial Sequence: Synthetic polypeptide
ESKLIILASGGPQALVNIMRTYTYETLLWTTSRVLKVLSV

SEQ ID NO: 610 - protein, 40 aa, Artificial Sequence
  Description of Artificial Sequence: Synthetic polypeptide
ILASGGPQALVNIMRTYTYETLLWTTSRVLKVLSVCSSNK

SEQ ID NO: 611 - protein, 40 aa, Artificial Sequence
  Description of Artificial Sequence: Synthetic polypeptide
LASGGPQALVNIMRTYTYETLLWTTSRVLKVLSVCSSNKP

SEQ ID NO: 612 - protein, 40 aa, Artificial Sequence
  Description of Artificial Sequence: Synthetic polypeptide
QALVNIMRTYTYETLLWTTSRVLKVLSVCSSNKPAIVEAG

SEQ ID NO: 613 - protein, 40 aa, Artificial Sequence
  Description of Artificial Sequence: Synthetic polypeptide
MATQADLMELDMAMEPDRKAAVSHWQQQSYLDSRIHSGAT

SEQ ID NO: 614 - protein, 40 aa, Artificial Sequence
  Description of Artificial Sequence: Synthetic polypeptide
ATQADLMELDMAMEPDRKAAVSHWQQQSYLDSRIHSGATT

SEQ ID NO: 615 - protein, 40 aa, Artificial Sequence
  Description of Artificial Sequence: Synthetic polypeptide
HWQQQSYLDSRIHSGATTTAPSLSGKGNPEEEDVDTSQVL

SEQ ID NO: 616 - protein, 40 aa, Artificial Sequence
  Description of Artificial Sequence: Synthetic polypeptide
QQSYLDSRIHSGATTTAPSLSGKGNPEEEDVDTSQVLYEW

SEQ ID NO: 617 - protein, 40 aa, Artificial Sequence
  Description of Artificial Sequence: Synthetic polypeptide
VLSVCSSNKPAIVEAGGMQALGLHLTDPSQRLVQNCLCTL

SEQ ID NO: 618 - protein, 40 aa, Artificial Sequence
  Description of Artificial Sequence: Synthetic polypeptide
LSVCSSNKPAIVEAGGMQALGLHLTDPSQRLVQNCLCTLR

SEQ ID NO: 619 - protein, 40 aa, Artificial Sequence
  Description of Artificial Sequence: Synthetic polypeptide
LVQNCLCTLRNLSDAATKQEGMEGLLGTLVQLLGSDDINV

SEQ ID NO: 620 - protein, 40 aa, Artificial Sequence
  Description of Artificial Sequence: Synthetic polypeptide
GLHLTDPSQRLVQNCLGTLRNLSDAATKQEGMEGLLGTLV

SEQ ID NO: 621 - protein, 40 aa, Artificial Sequence
  Description of Artificial Sequence: Synthetic polypeptide
RLVQNCLGTLRNLSDAATKQEGMEGLLGTLVQLLGSDDIN

SEQ ID NO: 622 - protein, 40 aa, Artificial Sequence
  Description of Artificial Sequence: Synthetic polypeptide
SQRLVQNCLWTLGNLSDAATKQEGMEGLLGTLVQLLGSDD

SEQ ID NO: 623 - protein, 40 aa, Artificial Sequence
  Description of Artificial Sequence: Synthetic polypeptide
CSSNKPAIVEAGGMQALGLHLTDPSQRLVQNCLWTLRILS

SEQ ID NO: 624 - protein, 40 aa, Artificial Sequence
  Description of Artificial Sequence: Synthetic polypeptide
LRILSDAATKQEGMEGLLGTLVQLLGSDDINVVTCAAGIL

SEQ ID NO: 625 - protein, 40 aa, Artificial Sequence
  Description of Artificial Sequence: Synthetic polypeptide
SNKPAIVEAGGMQALGLHLTDPSQRLVQNCLWTLRKLSDA

SEQ ID NO: 626 - protein, 40 aa, Artificial Sequence
  Description of Artificial Sequence: Synthetic polypeptide
GMQALGLHLTDPSQRLVQNCLWTLRKLSDAATKQEGMEGL

SEQ ID NO: 627 - protein, 40 aa, Artificial Sequence
  Description of Artificial Sequence: Synthetic polypeptide
KLSDAATKQEGMEGLLGTLVQLLGSDDINVVTCAAGILSN

SEQ ID NO: 628 - protein, 40 aa, Artificial Sequence
  Description of Artificial Sequence: Synthetic polypeptide
QALGLHLTDPSQRLVQNCLWTLRYLSDAATKQEGMEGLLG

SEQ ID NO: 629 - protein, 40 aa, Artificial Sequence
  Description of Artificial Sequence: Synthetic polypeptide
RLVQNCLWTLRYLSDAATKQEGMEGLLGTLVQLLGSDDIN

SEQ ID NO: 630 - protein, 40 aa, Artificial Sequence
  Description of Artificial Sequence: Synthetic polypeptide
LVQNCLWTLRYLSDAATKQEGMEGLLGTLVQLLGSDDINV

SEQ ID NO: 631 - protein, 40 aa, Artificial Sequence
  Description of Artificial Sequence: Synthetic polypeptide
VQNCLWTLRYLSDAATKQEGMEGLLGTLVQLLGSDDINVV

SEQ ID NO: 632 - protein, 40 aa, Artificial Sequence
  Description of Artificial Sequence: Synthetic polypeptide
SDAATKQEGMEGLLGTLVQLLGSDDINVVTCAAGILSDLT

SEQ ID NO: 633 - protein, 40 aa, Artificial Sequence
  Description of Artificial Sequence: Synthetic polypeptide
TKQEGMEGLLGTLVQLLGSDDINVVTCAAGILSDLTCNNY

SEQ ID NO: 634 - protein, 40 aa, Artificial Sequence
  Description of Artificial Sequence: Synthetic polypeptide
GLLGTLVQLLGSDDINVVTCAAGILSDLTCNNYKNKMMVC

SEQ ID NO: 635 - protein, 40 aa, Artificial Sequence
  Description of Artificial Sequence: Synthetic polypeptide
LLGTLVQLLGSDDINVVTCAAGILSDLTCNNYKNKMMVCQ

SEQ ID NO: 636 - protein, 40 aa, Artificial Sequence
  Description of Artificial Sequence: Synthetic polypeptide
LLGSDDINVVTCAAGILSDLTCNNYKNKMMVCQVGGIEAL

SEQ ID NO: 637 - protein, 40 aa, Artificial Sequence
  Description of Artificial Sequence: Synthetic polypeptide
SPILVATAVAARGLDISNVKHVINFDLPSDIEEYVHCIGR

SEQ ID NO: 638 - protein, 40 aa, Artificial Sequence
  Description of Artificial Sequence: Synthetic polypeptide
DISNVKHVINFDLPSDIEEYVHCIGRTGRVGNLGLATSFF

SEQ ID NO: 639 - protein, 40 aa, Artificial Sequence
  Description of Artificial Sequence: Synthetic polypeptide
KHVINFDLPSDIEEYVHCIGRTGRVGNLGLATSFFNERNI

SEQ ID NO: 640 - protein, 40 aa, Artificial Sequence
  Description of Artificial Sequence: Synthetic polypeptide
LPSDIEEYVHCIGRTGRVGNLGLATSFFNERNINITKDLL

SEQ ID NO: 641 - protein, 40 aa, Artificial Sequence
  Description of Artificial Sequence: Synthetic polypeptide
HCIGRTGRVGNLGLATSFFNERNINITKDLLDLLVEAKQE

SEQ ID NO: 642 - protein, 40 aa, Artificial Sequence
  Description of Artificial Sequence: Synthetic polypeptide
NFDLPSDIEEYVHRIGRAGRVGNLGLATSFFNERNINITK

SEQ ID NO: 643 - protein, 40 aa, Artificial Sequence
  Description of Artificial Sequence: Synthetic polypeptide
RAGRVGNLGLATSFFNERNINITKDLLDLLVEAKQEVPSW

SEQ ID NO: 644 - protein, 40 aa, Artificial Sequence
  Description of Artificial Sequence: Synthetic polypeptide
SNVKHVINFDLPSDIEEYVHRIGRMGRVGNLGLATSFFNE

SEQ ID NO: 645 - protein, 40 aa, Artificial Sequence
  Description of Artificial Sequence: Synthetic polypeptide
IEEYVHRIGRMGRVGNLGLATSFFNERNINITKDLLDLLV

SEQ ID NO: 646 - protein, 40 aa, Artificial Sequence
  Description of Artificial Sequence: Synthetic polypeptide
GFENFEKKINYRFKNKAYLLQAFTHASYHYNTITDCYQSL

SEQ ID NO: 647 - protein, 40 aa, Artificial Sequence
  Description of Artificial Sequence: Synthetic polypeptide
ENFEKKINYRFKNKAYLLQAFTHASYHYNTITDCYQSLEF

SEQ ID NO: 648 - protein, 40 aa, Artificial Sequence
  Description of Artificial Sequence: Synthetic polypeptide
NFEKKINYRFKNKAYLLQAFTHASYHYNTITDCYQSLEFL

SEQ ID NO: 649 - protein, 40 aa, Artificial Sequence
  Description of Artificial Sequence: Synthetic polypeptide
LLQAFTHASYHYNTITDCYQRLKFLGDAILDYLITKHLYE

SEQ ID NO: 650 - protein, 40 aa, Artificial Sequence
  Description of Artificial Sequence: Synthetic polypeptide
IDDFVQFQLEKNEMQGMDSELRRSEEDEEKEEDIEVPNAM

SEQ ID NO: 651 - protein, 40 aa, Artificial Sequence
  Description of Artificial Sequence: Synthetic polypeptide
DDFVQFQLEKNEMQGMDSELRRSEEDEEKEEDIEVPNAMG

SEQ ID NO: 652 - protein, 40 aa, Artificial Sequence
  Description of Artificial Sequence: Synthetic polypeptide
VQFQLEKNEMQGMDSELRRSEEDEEKEEDIEVPNAMGDIF

SEQ ID NO: 653 - protein, 40 aa, Artificial Sequence
  Description of Artificial Sequence: Synthetic polypeptide
FQLEKNEMQGMDSELRRSEEDEEKEEDIEVPNAMGDIFES

SEQ ID NO: 654 - protein, 40 aa, Artificial Sequence
  Description of Artificial Sequence: Synthetic polypeptide
RSEEDEEKEEDIEVPNAMGDIFESLAGAIYMDSGMSLETV

SEQ ID NO: 655 - protein, 40 aa, Artificial Sequence
  Description of Artificial Sequence: Synthetic polypeptide
DEEKEEDIEVPNAMGDIFESLAGAIYMDSGMSLETVWQVY

SEQ ID NO: 656 - protein, 40 aa, Artificial Sequence
  Description of Artificial Sequence: Synthetic polypeptide
NAMGDIFESLAGAIYMDSGMSLETVWQVYYPMMRPLIEKF

SEQ ID NO: 657 - protein, 40 aa, Artificial Sequence
  Description of Artificial Sequence: Synthetic polypeptide
FVQFQLEKNEMQGMDSELRRSEEDEEKEEDIEVPKAMRDI

SEQ ID NO: 658 - protein, 40 aa, Artificial Sequence
  Description of Artificial Sequence: Synthetic polypeptide
ELRRSEEDEEKEEDIEVPKAMRDIFESLAGAIYMDSGMSL

SEQ ID NO: 659 - protein, 40 aa, Artificial Sequence
  Description of Artificial Sequence: Synthetic polypeptide
AMRDIFESLAGAIYMDSGMSLETVWQVYYPMMRPLIEKFS

SEQ ID NO: 660 - protein, 40 aa, Artificial Sequence
  Description of Artificial Sequence: Synthetic polypeptide
VQFQLEKNEMQGMDSELRRSEEDEEKEEDIEVPKAMGYIF

SEQ ID NO: 661 - protein, 40 aa, Artificial Sequence
  Description of Artificial Sequence: Synthetic polypeptide
RSEEDEEKEEDIEVPKAMGYIFESLAGAIYMDSGMSLETV

SEQ ID NO: 662 - protein, 40 aa, Artificial Sequence
  Description of Artificial Sequence: Synthetic polypeptide
EVPKAMGYIFESLAGAIYMDSGMSLETVWQVYYPMMRPLI

SEQ ID NO: 663 - protein, 40 aa, Artificial Sequence
  Description of Artificial Sequence: Synthetic polypeptide
AMGYIFESLAGAIYMDSGMSLETVWQVYYPMMRPLIEKFS

SEQ ID NO: 664 - protein, 40 aa, Artificial Sequence
  Description of Artificial Sequence: Synthetic polypeptide
QLEKNEMQGMDSELRRSEEDEEKEEDIEVPKAMGDIFDSL

SEQ ID NO: 665 - protein, 40 aa, Artificial Sequence
  Description of Artificial Sequence: Synthetic polypeptide
LRRSEEDEEKEEDIEVPKAMGDIFDSLAGAIYMDSGMSLE

SEQ ID NO: 666 - protein, 40 aa, Artificial Sequence
  Description of Artificial Sequence: Synthetic polypeptide
RSEEDEEKEEDIEVPKAMGDIFDSLAGAIYMDSGMSLETV

SEQ ID NO: 667 - protein, 40 aa, Artificial Sequence
  Description of Artificial Sequence: Synthetic polypeptide
EDIEVPKAMGDIFDSLAGAIYMDSGMSLETVWQVYYPMMR

SEQ ID NO: 668 - protein, 40 aa, Artificial Sequence
  Description of Artificial Sequence: Synthetic polypeptide
KAMGDIFDSLAGAIYMDSGMSLETVWQVYYPMMRPLIEKF

SEQ ID NO: 669 - protein, 40 aa, Artificial Sequence
  Description of Artificial Sequence: Synthetic polypeptide
FQLEKNEMQGMDSELRRSEEDEEKEEDIEVPKAMGDIFGS

SEQ ID NO: 670 - protein, 40 aa, Artificial Sequence
  Description of Artificial Sequence: Synthetic polypeptide
SEEDEEKEEDIEVPKAMGDIFGSLAGAIYMDSGMSLETVW

SEQ ID NO: 671 - protein, 40 aa, Artificial Sequence
  Description of Artificial Sequence: Synthetic polypeptide
AMGDIFGSLAGAIYMDSGMSLETVWQVYYPMMRPLIEKFS

SEQ ID NO: 672 - protein, 40 aa, Artificial Sequence
  Description of Artificial Sequence: Synthetic polypeptide
FLKTIQEVAGYVLIALNTVERIPLENLQIIGGNMYYENSY

SEQ ID NO: 673 - protein, 40 aa, Artificial Sequence
  Description of Artificial Sequence: Synthetic polypeptide
TIQEVAGYVLIALNTVERIPLENLQIIGGNMYYENSYALA

SEQ ID NO: 674 - protein, 40 aa, Artificial Sequence
  Description of Artificial Sequence: Synthetic polypeptide
TVERIPLENLQIIGGNMYYENSYALAVLSNYDANKTGLKE

SEQ ID NO: 675 - protein, 40 aa, Artificial Sequence
  Description of Artificial Sequence: Synthetic polypeptide
AGYVLIALNTVERIPLENLQIIKGNMYYENSYALAVLSNY

SEQ ID NO: 676 - protein, 40 aa, Artificial Sequence
  Description of Artificial Sequence: Synthetic polypeptide
LNTVERIPLENLQIIKGNMYYENSYALAVLSNYDANKTGL

SEQ ID NO: 677 - protein, 40 aa, Artificial Sequence
  Description of Artificial Sequence: Synthetic polypeptide
LQIIKGNMYYENSYALAVLSNYDANKTGLKELPMRNLQEI

SEQ ID NO: 678 - protein, 40 aa, Artificial Sequence
  Description of Artificial Sequence: Synthetic polypeptide
CCHNQCAAGCTGPRESDCLVCCKFRDEATCKDTCPPLMLY

SEQ ID NO: 679 - protein, 40 aa, Artificial Sequence
  Description of Artificial Sequence: Synthetic polypeptide
GCTGPRESDCLVCCKFRDEATCKDTCPPLMLYNPTTYQMD

SEQ ID NO: 680 - protein, 40 aa, Artificial Sequence
  Description of Artificial Sequence: Synthetic polypeptide
NQCAAGCTGPRESDCLVCRKFRDEATCKDTCPPLMLCNPT

SEQ ID NO: 681 - protein, 40 aa, Artificial Sequence
  Description of Artificial Sequence: Synthetic polypeptide
PTTYQMDVNPEGKYSFGTTCVKKCPRNYVVTDHGSCVRAC

SEQ ID NO: 682 - protein, 40 aa, Artificial Sequence
  Description of Artificial Sequence: Synthetic polypeptide
VNPEGKYSFGTTCVKKCPRNYVVTDHGSCVRACGADSYEM

SEQ ID NO: 683 - protein, 40 aa, Artificial Sequence
  Description of Artificial Sequence: Synthetic polypeptide
PDNCIQCAHYIDGPHCVKTCRAGVMGENNTLVWKYADAGH

SEQ ID NO: 684 - protein, 40 aa, Artificial Sequence
  Description of Artificial Sequence: Synthetic polypeptide
PHCVKTCRAGVMGENNTLVWKYADAGHVCHLCHPNCTYGC

SEQ ID NO: 685 - protein, 40 aa, Artificial Sequence
  Description of Artificial Sequence: Synthetic polypeptide
TCTGRGPDNCIQCAHYIDGPHCVKTCSAGVMGENNTLVWK

SEQ ID NO: 686 - protein, 40 aa, Artificial Sequence
  Description of Artificial Sequence: Synthetic polypeptide
CTGRGPDNCIQCAHYIDGPHCVKTCSAGVMGENNTLVWKY

SEQ ID NO: 687 - protein, 40 aa, Artificial Sequence
  Description of Artificial Sequence: Synthetic polypeptide
AHYIDGPHCVKTCSAGVMGENNTLVWKYADAGHVCHLCHP

SEQ ID NO: 688 - protein, 40 aa, Artificial Sequence
  Description of Artificial Sequence: Synthetic polypeptide
ITCTGRGPDNCIQCAHYIDGPHCVKTCPAVVMGENNTLVW

SEQ ID NO: 689 - protein, 40 aa, Artificial Sequence
  Description of Artificial Sequence: Synthetic polypeptide
GPDNCIQCAHYIDGPHCVKTCPAVVMGENNTLVWKYADAG

SEQ ID NO: 690 - protein, 40 aa, Artificial Sequence
  Description of Artificial Sequence: Synthetic polypeptide
QCAHYIDGPHCVKTCPAVVMGENNTLVWKYADAGHVCHLC

SEQ ID NO: 691 - protein, 40 aa, Artificial Sequence
  Description of Artificial Sequence: Synthetic polypeptide
TLVWKYADAGHVCHLCHPNCTYGFTGPGLEGCPTNGPKIP

SEQ ID NO: 692 - protein, 40 aa, Artificial Sequence
  Description of Artificial Sequence: Synthetic polypeptide
DAGHVCHLCHPNCTYGFTGPGLEGCPTNGPKIPSIATGMV

SEQ ID NO: 693 - protein, 40 aa, Artificial Sequence
  Description of Artificial Sequence: Synthetic polypeptide
LKETEFKKIKVLCSGAFGTVYKGLWIPEGEKVKIPVAIKE

SEQ ID NO: 694 - protein, 40 aa, Artificial Sequence
  Description of Artificial Sequence: Synthetic polypeptide
ETEFKKIKVLCSGAFGTVYKGLWIPEGEKVKIPVAIKELR

SEQ ID NO: 695 - protein, 40 aa, Artificial Sequence
  Description of Artificial Sequence: Synthetic polypeptide
LQERELVEPLTPSGEAPNQALLRILKETEFKKIKVLDSGA

SEQ ID NO: 696 - protein, 40 aa, Artificial Sequence
  Description of Artificial Sequence: Synthetic polypeptide
EAPNQALLRILKETEFKKIKVLDSGAFGTVYKGLWIPEGE

SEQ ID NO: 697 - protein, 40 aa, Artificial Sequence
  Description of Artificial Sequence: Synthetic polypeptide
APNQALLRILKETEFKKIKVLDSGAFGTVYKGLWIPEGEK

SEQ ID NO: 698 - protein, 40 aa, Artificial Sequence
  Description of Artificial Sequence: Synthetic polypeptide
ETEFKKIKVLDSGAFGTVYKGLWIPEGEKVKIPVAIKELR

SEQ ID NO: 699 - protein, 40 aa, Artificial Sequence
  Description of Artificial Sequence: Synthetic polypeptide
TEFKKIKVLDSGAFGTVYKGLWIPEGEKVKIPVAIKELRE

SEQ ID NO: 700 - protein, 40 aa, Artificial Sequence
  Description of Artificial Sequence: Synthetic polypeptide
ERELVEPLTPSGEAPNQALLRILKETEFKKIKVLGSGAFS

SEQ ID NO: 701 - protein, 40 aa, Artificial Sequence
  Description of Artificial Sequence: Synthetic polypeptide
RELVEPLTPSGEAPNQALLRILKETEFKKIKVLGSGAFST

SEQ ID NO: 702 - protein, 40 aa, Artificial Sequence
  Description of Artificial Sequence: Synthetic polypeptide
GSGAFSTVYKGLWIPEGEKVKIPVAIKELREATSPKANKE

SEQ ID NO: 703 - protein, 40 aa, Artificial Sequence
  Description of Artificial Sequence: Synthetic polypeptide
SGAFSTVYKGLWIPEGEKVKIPVAIKELREATSPKANKEI

SEQ ID NO: 704 - protein, 40 aa, Artificial Sequence
  Description of Artificial Sequence: Synthetic polypeptide
SGAFGTVYKGLWIPEGEKVKIPVAIKELREATSPKANKEN

SEQ ID NO: 705 - protein, 40 aa, Artificial Sequence
  Description of Artificial Sequence: Synthetic polypeptide
VYKGLWIPEGEKVKIPVAIKELREATSPKANKENLDEAYV

SEQ ID NO: 706 - protein, 40 aa, Artificial Sequence
  Description of Artificial Sequence: Synthetic polypeptide
PEGEKVKIPVAIKELREATSPKANKENLDEAYVMASVDNP

SEQ ID NO: 707 - protein, 40 aa, Artificial Sequence
  Description of Artificial Sequence: Synthetic polypeptide
EKVKIPVAIKELREATSPKANKENLDEAYVMASVDNPHVC

SEQ ID NO: 708 - protein, 40 aa, Artificial Sequence
  Description of Artificial Sequence: Synthetic polypeptide
YVREHKDNIGSQYLLNWCVQIAKGMNYLEDRRLVHHDLAA

SEQ ID NO: 709 - protein, 40 aa, Artificial Sequence
  Description of Artificial Sequence: Synthetic polypeptide
MNYLEDRRLVHHDLAARNVLVKTPQHVKITDFGLAKLLGA

SEQ ID NO: 710 - protein, 40 aa, Artificial Sequence
  Description of Artificial Sequence: Synthetic polypeptide
LAARNVLVKTPQHVKITDFGRAKLLGAEEKEYHAEGGKVP

SEQ ID NO: 711 - protein, 40 aa, Artificial Sequence
  Description of Artificial Sequence: Synthetic polypeptide
VKTPQHVKITDFGRAKLLGAEEKEYHAEGGKVPIKWMALE

SEQ ID NO: 712 - protein, 40 aa, Artificial Sequence
  Description of Artificial Sequence: Synthetic polypeptide
TPQHVKITDFGRAKLLGAEEKEYHAEGGKVPIKWMALESI

SEQ ID NO: 713 - protein, 40 aa, Artificial Sequence
  Description of Artificial Sequence: Synthetic polypeptide
LSLQRMFNNCEVVLGNLEITYVQRNYDLSFLKTIQEMAGY

SEQ ID NO: 714 - protein, 40 aa, Artificial Sequence
  Description of Artificial Sequence: Synthetic polypeptide
NLEITYVQRNYDLSFLKTIQEMAGYVLIALNTVERIPLEN

SEQ ID NO: 715 - protein, 40 aa, Artificial Sequence
  Description of Artificial Sequence: Synthetic polypeptide
YDLSFLKTIQEMAGYVLIALNTVERIPLENLQIIRGNMYY

SEQ ID NO: 716 - protein, 40 aa, Artificial Sequence
  Description of Artificial Sequence: Synthetic polypeptide
FLKTIQEMAGYVLIALNTVERIPLENLQIIRGNMYYENSY

SEQ ID NO: 717 - protein, 40 aa, Artificial Sequence
  Description of Artificial Sequence: Synthetic polypeptide
KTIQEMAGYVLIALNTVERIPLENLQIIRGNMYYENSYAL

SEQ ID NO: 718 - protein, 40 aa, Artificial Sequence
  Description of Artificial Sequence: Synthetic polypeptide
EMAGYVLIALNTVERIPLENLQIIRGNMYYENSYALAVLS

SEQ ID NO: 719 - protein, 40 aa, Artificial Sequence
  Description of Artificial Sequence: Synthetic polypeptide
RNVLVKTPQHVKITDFGLAKQLGAEEKEYHAEGGKVPIKW

SEQ ID NO: 720 - protein, 40 aa, Artificial Sequence
  Description of Artificial Sequence: Synthetic polypeptide
LVKTPQHVKITDFGLAKQLGAEEKEYHAEGGKVPIKWMAL

SEQ ID NO: 721 - protein, 40 aa, Artificial Sequence
  Description of Artificial Sequence: Synthetic polypeptide
KTPQHVKITDFGLAKQLGAEEKEYHAEGGKVPIKWMALES

SEQ ID NO: 722 - protein, 40 aa, Artificial Sequence
  Description of Artificial Sequence: Synthetic polypeptide
TPQHVKITDFGLAKQLGAEEKEYHAEGGKVPIKWMALESI

SEQ ID NO: 723 - protein, 40 aa, Artificial Sequence
  Description of Artificial Sequence: Synthetic polypeptide
ITDFGLAKLLGAEEKEYHAEGGKVPIKWMALESILHRICT

SEQ ID NO: 724 - protein, 40 aa, Artificial Sequence
  Description of Artificial Sequence: Synthetic polypeptide
AKLLGAEEKEYHAEGGKVPIKWMALESILHRICTHQSDVW

SEQ ID NO: 725 - protein, 40 aa, Artificial Sequence
  Description of Artificial Sequence: Synthetic polypeptide
GKVPIKWMALESILHRICTHQSDVWSYGVTVWELMTFGSK

SEQ ID NO: 726 - protein, 40 aa, Artificial Sequence
  Description of Artificial Sequence: Synthetic polypeptide
IDGVDLCFFGMHVQEYGSDCPPPNQRRVYISYPDSVHFFR

SEQ ID NO: 727 - protein, 40 aa, Artificial Sequence
  Description of Artificial Sequence: Synthetic polypeptide
VQEYGSDCPPPNQRRVYISYLDIVHFFRPKCLRTAVYHEI

SEQ ID NO: 728 - protein, 40 aa, Artificial Sequence
  Description of Artificial Sequence: Synthetic polypeptide
DCPPPNQRRVYISYLDIVHFFRPKCLRTAVYHEILIGYLE

SEQ ID NO: 729 - protein, 40 aa, Artificial Sequence
  Description of Artificial Sequence: Synthetic polypeptide
CPPPNQRRVYISYLDIVHFFRPKCLRTAVYHEILIGYLEY

SEQ ID NO: 730 - protein, 40 aa, Artificial Sequence
  Description of Artificial Sequence: Synthetic polypeptide
YGSDCPPPNQRRVYISYLDSVHFFRPKCLRTAVCHEILIG

SEQ ID NO: 731 - protein, 40 aa, Artificial Sequence
  Description of Artificial Sequence: Synthetic polypeptide
VYISYLDSVHFFRPKCLRTAVCHEILIGYLEYVKKLGYTT

SEQ ID NO: 732 - protein, 40 aa, Artificial Sequence
  Description of Artificial Sequence: Synthetic polypeptide
SYLDSVHFFRPKCLRTAVCHEILIGYLEYVKKLGYTTGHI

SEQ ID NO: 733 - protein, 40 aa, Artificial Sequence
  Description of Artificial Sequence: Synthetic polypeptide
PPPNQRRVYISYLDSVHFFRPKCLRTAVDHEILIGYLEYV

SEQ ID NO: 734 - protein, 40 aa, Artificial Sequence
  Description of Artificial Sequence: Synthetic polypeptide
YLEYVKKLGYTTGHIWACPPSEGDDCIFHCHPPDQKIPKP

SEQ ID NO: 735 - protein, 40 aa, Artificial Sequence
  Description of Artificial Sequence: Synthetic polypeptide
EILIGYLEYVKKLGYTTGHIWACPPSEGDDYIFHCPPPDQ

SEQ ID NO: 736 - protein, 40 aa, Artificial Sequence
  Description of Artificial Sequence: Synthetic polypeptide
YVKKLGYTTGHIWACPPSEGDDYIFHCPPPDQKIPKPKRL

SEQ ID NO: 737 - protein, 40 aa, Artificial Sequence
  Description of Artificial Sequence: Synthetic polypeptide
PEGRYTFGASCVTACPYNYLSTDVGFCTLVCPLHNQEVTA

SEQ ID NO: 738 - protein, 40 aa, Artificial Sequence
  Description of Artificial Sequence: Synthetic polypeptide
STDVGFCTLVCPLHNQEVTAEDGTQRCEKCSKPCARVCYG

SEQ ID NO: 739 - protein, 40 aa, Artificial Sequence
  Description of Artificial Sequence: Synthetic polypeptide
AFGTVYKGIWIPDGENVKIPVAIKVMRENTSPKANKEILD

SEQ ID NO: 740 - protein, 40 aa, Artificial Sequence
  Description of Artificial Sequence: Synthetic polypeptide
GTVYKGIWIPDGENVKIPVAIKVMRENTSPKANKEILDEA

SEQ ID NO: 741 - protein, 40 aa, Artificial Sequence
  Description of Artificial Sequence: Synthetic polypeptide
VYKGIWIPDGENVKIPVAIKVMRENTSPKANKEILDEAYV

SEQ ID NO: 742 - protein, 40 aa, Artificial Sequence
  Description of Artificial Sequence: Synthetic polypeptide
KVKVLGSGAFGTVYKGIWIPDGENVKIPVAIKVSRENTSP

SEQ ID NO: 743 - protein, 40 aa, Artificial Sequence
  Description of Artificial Sequence: Synthetic polypeptide
HNADLSFLQWIREVTGYVLVAMNEFSTLPLPNLHVVRGTQ

SEQ ID NO: 744 - protein, 40 aa, Artificial Sequence
  Description of Artificial Sequence: Synthetic polypeptide
GYVLVAMNEFSTLPLPNLHVVRGTQVYDGKFAIFVMLNYN

SEQ ID NO: 745 - protein, 40 aa, Artificial Sequence
  Description of Artificial Sequence: Synthetic polypeptide
TKTICAPQCNGHCFGPNPNQCCHDECVGGCSGPQDTDCFA

SEQ ID NO: 746 - protein, 40 aa, Artificial Sequence
  Description of Artificial Sequence: Synthetic polypeptide
DHPHLVRLLRVCLSPTIQLVTQLMPHGCLLEYVHEHKDNI

SEQ ID NO: 747 - protein, 40 aa, Artificial Sequence
  Description of Artificial Sequence: Synthetic polypeptide
PHLVRLLRVCLSPTIQLVTQLMPHGCLLEYVHEHKDNIGS

SEQ ID NO: 748 - protein, 40 aa, Artificial Sequence
  Description of Artificial Sequence: Synthetic polypeptide
LRVCLSPTIQLVTQLMPHGCLLEYVHEHKDNIGSQLLLNW

SEQ ID NO: 749 - protein, 40 aa, Artificial Sequence
  Description of Artificial Sequence: Synthetic polypeptide
NETTGPKANVEFMDEALIMASMDHPHLVRLLVVCLSPTIQ

SEQ ID NO: 750 - protein, 40 aa, Artificial Sequence
  Description of Artificial Sequence: Synthetic polypeptide
EFMDEALIMASMDHPHLVRLLVVCLSPTIQLVTQLMPHGC

SEQ ID NO: 751 - protein, 40 aa, Artificial Sequence
  Description of Artificial Sequence: Synthetic polypeptide
MDEALIMASMDHPHLVRLLVVCLSPTIQLVTQLMPHGCLL

SEQ ID NO: 752 - protein, 40 aa, Artificial Sequence
  Description of Artificial Sequence: Synthetic polypeptide
SRDATLRVWDIETGQCLHVLMGHVAAVRLVQYDGRRVVSG

SEQ ID NO: 753 - protein, 40 aa, Artificial Sequence
  Description of Artificial Sequence: Synthetic polypeptide
TLRVWDIETGQCLHVLMGHVAAVRLVQYDGRRVVSGAYDF

SEQ ID NO: 754 - protein, 40 aa, Artificial Sequence
  Description of Artificial Sequence: Synthetic polypeptide
DIETGQCLHVLMGHVAAVRLVQYDGRRVVSGAYDFMVKVW

SEQ ID NO: 755 - protein, 40 aa, Artificial Sequence
  Description of Artificial Sequence: Synthetic polypeptide
IETGQCLHVLMGHVAAVRLVQYDGRRVVSGAYDFMVKVWD

SEQ ID NO: 756 - protein, 40 aa, Artificial Sequence
  Description of Artificial Sequence: Synthetic polypeptide
TGQCLHVLMGHVAAVRLVQYDGRRVVSGAYDFMVKVWDPE

SEQ ID NO: 757 - protein, 40 aa, Artificial Sequence
  Description of Artificial Sequence: Synthetic polypeptide
CLHVLMGHVAAVRLVQYDGRRVVSGAYDFMVKVWDPETET

SEQ ID NO: 758 - protein, 40 aa, Artificial Sequence
  Description of Artificial Sequence: Synthetic polypeptide
HVLMGHVAAVRLVQYDGRRVVSGAYDFMVKVWDPETETCL

SEQ ID NO: 759 - protein, 40 aa, Artificial Sequence
  Description of Artificial Sequence: Synthetic polypeptide
LMGHVAAVRLVQYDGRRVVSGAYDFMVKVWDPETETCLHT

SEQ ID NO: 760 - protein, 40 aa, Artificial Sequence
  Description of Artificial Sequence: Synthetic polypeptide
GHVAAVRLVQYDGRRVVSGAYDFMVKVWDPETETCLHTLQ

SEQ ID NO: 761 - protein, 40 aa, Artificial Sequence
  Description of Artificial Sequence: Synthetic polypeptide
QYDGRRVVSGAYDFMVKVWDPETETCLHTLQGHTNRVCSL

SEQ ID NO: 762 - protein, 40 aa, Artificial Sequence
  Description of Artificial Sequence: Synthetic polypeptide
DGRRVVSGAYDFMVKVWDPETETCLHTLQGHTNRVCSLQF

SEQ ID NO: 763 - protein, 40 aa, Artificial Sequence
  Description of Artificial Sequence: Synthetic polypeptide
SGAYDFMVKVWDPETETCLHTLQGHTNRVCSLQFDGIHVV

SEQ ID NO: 764 - protein, 40 aa, Artificial Sequence
  Description of Artificial Sequence: Synthetic polypeptide
AYDFMVKVWDPETETCLHTLQGHTNRVCSLQFDGIHVVSG

SEQ ID NO: 765 - protein, 40 aa, Artificial Sequence
  Description of Artificial Sequence: Synthetic polypeptide
MVKVWDPETETCLHTLQGHTNRVCSLQFDGIHVVSGSLDT

SEQ ID NO: 766 - protein, 40 aa, Artificial Sequence
  Description of Artificial Sequence: Synthetic polypeptide
VKVWDPETETCLHTLQGHTNRVCSLQFDGIHVVSGSLDTS

SEQ ID NO: 767 - protein, 40 aa, Artificial Sequence
  Description of Artificial Sequence: Synthetic polypeptide
WDPETETCLHTLQGHTNRVCSLQFDGIHVVSGSLDTSIRV

SEQ ID NO: 768 - protein, 40 aa, Artificial Sequence
  Description of Artificial Sequence: Synthetic polypeptide
PETETCLHTLQGHTNRVCSLQFDGIHVVSGSLDTSIRVWD

SEQ ID NO: 769 - protein, 40 aa, Artificial Sequence
  Description of Artificial Sequence: Synthetic polypeptide
ETETCLHTLQGHTNRVCSLQFDGIHVVSGSLDTSIRVWDV

SEQ ID NO: 770 - protein, 40 aa, Artificial Sequence
  Description of Artificial Sequence: Synthetic polypeptide
ETCLHTLQGHTNRVCSLQFDGIHVVSGSLDTSIRVWDVET

SEQ ID NO: 771 - protein, 40 aa, Artificial Sequence
  Description of Artificial Sequence: Synthetic polypeptide
HTLQGHTNRVCSLQFDGIHVVSGSLDTSIRVWDVETGNCI

SEQ ID NO: 772 - protein, 40 aa, Artificial Sequence
  Description of Artificial Sequence: Synthetic polypeptide
CSLQFDGIHVVSGSLDTSIRVWDVETGNCIHTLTGHQSLT

SEQ ID NO: 773 - protein, 40 aa, Artificial Sequence
  Description of Artificial Sequence: Synthetic polypeptide
YDGRRVVSGAYDFMVKVWDPETETCLHTLQGHTNRVHSLQ

SEQ ID NO: 774 - protein, 40 aa, Artificial Sequence
  Description of Artificial Sequence: Synthetic polypeptide
HTLQGHTNRVHSLQFDGIHVVSGSLDTSIRVWDVETGNCI

SEQ ID NO: 775 - protein, 40 aa, Artificial Sequence
  Description of Artificial Sequence: Synthetic polypeptide
TLQGHTNRVHSLQFDGIHVVSGSLDTSIRVWDVETGNCIH

SEQ ID NO: 776 - protein, 40 aa, Artificial Sequence
  Description of Artificial Sequence: Synthetic polypeptide
NRVHSLQFDGIHVVSGSLDTSIRVWDVETGNCIHTLTGHQ

SEQ ID NO: 777 - protein, 40 aa, Artificial Sequence
  Description of Artificial Sequence: Synthetic polypeptide
VKVWDPETETCLHTLQGHTNRVYSLQFDGIHVVSGSQDTS

SEQ ID NO: 778 - protein, 40 aa, Artificial Sequence
  Description of Artificial Sequence: Synthetic polypeptide
ETCLHTLQGHTNRVYSLQFDGIHVVSGSQDTSIRVWDVET

SEQ ID NO: 779 - protein, 40 aa, Artificial Sequence
  Description of Artificial Sequence: Synthetic polypeptide
LHTLQGHTNRVYSLQFDGIHVVSGSQDTSIRVWDVETGNC

SEQ ID NO: 780 - protein, 40 aa, Artificial Sequence
  Description of Artificial Sequence: Synthetic polypeptide
HTNRVYSLQFDGIHVVSGSQDTSIRVWDVETGNCIHTLTG

SEQ ID NO: 781 - protein, 40 aa, Artificial Sequence
  Description of Artificial Sequence: Synthetic polypeptide
NRVYSLQFDGIHVVSGSQDTSIRVWDVETGNCIHTLTGHQ

SEQ ID NO: 782 - protein, 40 aa, Artificial Sequence
  Description of Artificial Sequence: Synthetic polypeptide
QFDGIHVVSGSQDTSIRVWDVETGNCIHTLTGHQSLTSGM

SEQ ID NO: 783 - protein, 40 aa, Artificial Sequence
  Description of Artificial Sequence: Synthetic polypeptide
RVYSLQFDGIHVVSGSLDTSIRVWDVETGNCIHTLTGHQV

SEQ ID NO: 784 - protein, 40 aa, Artificial Sequence
  Description of Artificial Sequence: Synthetic polypeptide
LQFDGIHVVSGSLDTSIRVWDVETGNCIHTLTGHQVLTSG

SEQ ID NO: 785 - protein, 40 aa, Artificial Sequence
  Description of Artificial Sequence: Synthetic polypeptide
QFDGIHVVSGSLDTSIRVWDVETGNCIHTLTGHQVLTSGM

SEQ ID NO: 786 - protein, 40 aa, Artificial Sequence
  Description of Artificial Sequence: Synthetic polypeptide
SGSLDTSIRVWDVETGNCIHTLTGHQVLTSGMELKDNILV

SEQ ID NO: 787 - protein, 40 aa, Artificial Sequence
  Description of Artificial Sequence: Synthetic polypeptide
LDTSIRVWDVETGNCIHTLTGHQVLTSGMELKDNILVSGN

SEQ ID NO: 788 - protein, 40 aa, Artificial Sequence
  Description of Artificial Sequence: Synthetic polypeptide
GNCIHTLTGHQVLTSGMELKDNILVSGNADSTVKIWDIKT

SEQ ID NO: 789 - protein, 40 aa, Artificial Sequence
  Description of Artificial Sequence: Synthetic polypeptide
HTLTGHQVLTSGMELKDNILVSGNADSTVKIWDIKTGQCL

SEQ ID NO: 790 - protein, 40 aa, Artificial Sequence
  Description of Artificial Sequence: Synthetic polypeptide
DGIHVVSGSLDTSIRVWDVETGNCIHTLTGHQSLTGGMEL

SEQ ID NO: 791 - protein, 40 aa, Artificial Sequence
  Description of Artificial Sequence: Synthetic polypeptide
VSGSLDTSIRVWDVETGNCIHTLTGHQSLTGGMELKDNIL

SEQ ID NO: 792 - protein, 40 aa, Artificial Sequence
  Description of Artificial Sequence: Synthetic polypeptide
CIHTLTGHQSLTGGMELKDNILVSGNADSTVKIWDIKTGQ

SEQ ID NO: 793 - protein, 40 aa, Artificial Sequence
  Description of Artificial Sequence: Synthetic polypeptide
HTLTGHQSLTGGMELKDNILVSGNADSTVKIWDIKTGQCL

SEQ ID NO: 794 - protein, 40 aa, Artificial Sequence
  Description of Artificial Sequence: Synthetic polypeptide
GGMELKDNILVSGNADSTVKIWDIKTGQCLQTLQGPNKHQ

SEQ ID NO: 795 - protein, 40 aa, Artificial Sequence
  Description of Artificial Sequence: Synthetic polypeptide
SLDTSIRVWDVETGNCIHTLTGHQSLTSGMELKDNILVNG

SEQ ID NO: 796 - protein, 40 aa, Artificial Sequence
  Description of Artificial Sequence: Synthetic polypeptide
VETGNCIHTLTGHQSLTSGMELKDNILVNGNADSTVKIWD

SEQ ID NO: 797 - protein, 40 aa, Artificial Sequence
  Description of Artificial Sequence: Synthetic polypeptide
TLTGHQSLTSGMELKDNILVNGNADSTVKIWDIKTGQCLQ

SEQ ID NO: 798 - protein, 40 aa, Artificial Sequence
  Description of Artificial Sequence: Synthetic polypeptide
SGMELKDNILVNGNADSTVKIWDIKTGQCLQTLQGPNKHQ

SEQ ID NO: 799 - protein, 40 aa, Artificial Sequence
  Description of Artificial Sequence: Synthetic polypeptide
DVETGNCIHTLTGHQSLTSGMELKDNILVRGNADSTVKIW

SEQ ID NO: 800 - protein, 40 aa, Artificial Sequence
  Description of Artificial Sequence: Synthetic polypeptide
NCIHTLTGHQSLTSGMELKDNILVRGNADSTVKIWDIKTG

SEQ ID NO: 801 - protein, 40 aa, Artificial Sequence
  Description of Artificial Sequence: Synthetic polypeptide
TLTGHQSLTSGMELKDNILVSENADSTVKIWDIKTGQCLQ

SEQ ID NO: 802 - protein, 40 aa, Artificial Sequence
  Description of Artificial Sequence: Synthetic polypeptide
DNILVSENADSTVKIWDIKTGQCLQTLQGPNKHQSAVTCL

SEQ ID NO: 803 - protein, 40 aa, Artificial Sequence
  Description of Artificial Sequence: Synthetic polypeptide
VWDVETGNCIHTLTGHQSLTSGMELKDNILVSRNADSTVK

SEQ ID NO: 804 - protein, 40 aa, Artificial Sequence
  Description of Artificial Sequence: Synthetic polypeptide
GHQSLTSGMELKDNILVSRNADSTVKIWDIKTGQCLQTLQ

SEQ ID NO: 805 - protein, 40 aa, Artificial Sequence
  Description of Artificial Sequence: Synthetic polypeptide
ELKDNILVSRNADSTVKIWDIKTGQCLQTLQGPNKHQSAV

SEQ ID NO: 806 - protein, 40 aa, Artificial Sequence
  Description of Artificial Sequence: Synthetic polypeptide
DNILVSRNADSTVKIWDIKTGQCLQTLQGPNKHQSAVTCL

SEQ ID NO: 807 - protein, 40 aa, Artificial Sequence
  Description of Artificial Sequence: Synthetic polypeptide
GNCIHTLTGHQSLTSGMELKDNILVSGNANSTVKIWDIKT

SEQ ID NO: 808 - protein, 40 aa, Artificial Sequence
  Description of Artificial Sequence: Synthetic polypeptide
IHTLTGHQSLTSGMELKDNILVSGNANSTVKIWDIKTGQC

SEQ ID NO: 809 - protein, 40 aa, Artificial Sequence
  Description of Artificial Sequence: Synthetic polypeptide
GNADSTVKIWDIKTGQCLQTLQGPNKHQCAVTCLQFNKNF

SEQ ID NO: 810 - protein, 40 aa, Artificial Sequence
  Description of Artificial Sequence: Synthetic polypeptide
IKTGQCLQTLQGPNKHQCAVTCLQFNKNFVITSSDDGTVK

SEQ ID NO: 811 - protein, 40 aa, Artificial Sequence
  Description of Artificial Sequence: Synthetic polypeptide
QCLQTLQGPNKHQCAVTCLQFNKNFVITSSDDGTVKLWDL

SEQ ID NO: 812 - protein, 40 aa, Artificial Sequence
  Description of Artificial Sequence: Synthetic polypeptide
LQTLQGPNKHQCAVTCLQFNKNFVITSSDDGTVKLWDLKT

SEQ ID NO: 813 - protein, 40 aa, Artificial Sequence
  Description of Artificial Sequence: Synthetic polypeptide
QHWSLIMESVVPSDKGNYTCVVENEYGSINHTYHLDVVEQ

SEQ ID NO: 814 - protein, 40 aa, Artificial Sequence
  Description of Artificial Sequence: Synthetic polypeptide
KEAVTVAVKMLKDDATEKDLSDLVSEMEMMKMIGKQKNII

SEQ ID NO: 815 - protein, 40 aa, Artificial Sequence
  Description of Artificial Sequence: Synthetic polypeptide
AVTVAVKMLKDDATEKDLSDLVSEMEMMKMIGKQKNIINL

SEQ ID NO: 816 - protein, 40 aa, Artificial Sequence
  Description of Artificial Sequence: Synthetic polypeptide
AVKMLKDDATEKDLSDLVSEMEMMKMIGKQKNIINLLGAC

SEQ ID NO: 817 - protein, 40 aa, Artificial Sequence
  Description of Artificial Sequence: Synthetic polypeptide
MLKDDATEKDLSDLVSEMEMMKMIGKQKNIINLLGACTQD

SEQ ID NO: 818 - protein, 40 aa, Artificial Sequence
  Description of Artificial Sequence: Synthetic polypeptide
DDATEKDLSDLVSEMEMMKMIGKQKNIINLLGACTQDGPL

SEQ ID NO: 819 - protein, 40 aa, Artificial Sequence
  Description of Artificial Sequence: Synthetic polypeptide
QKNIINLLGACTQDGPLYVIVEYASKGNLREYLRARRPPG

SEQ ID NO: 820 - protein, 40 aa, Artificial Sequence
  Description of Artificial Sequence: Synthetic polypeptide
ECSPHRPILQAGLPANQTAVLGSDVEFHCKVYSDAQPHIQ

SEQ ID NO: 821 - protein, 40 aa, Artificial Sequence
  Description of Artificial Sequence: Synthetic polypeptide
QWSLVMESVVPSDRGNYTCVVENKFGSIRQTYTLDVLERC

SEQ ID NO: 822 - protein, 40 aa, Artificial Sequence
  Description of Artificial Sequence: Synthetic polypeptide
WSLVMESVVPSDRGNYTCVVENKFGSIRQTYTLDVLERCP

SEQ ID NO: 823 - protein, 40 aa, Artificial Sequence
  Description of Artificial Sequence: Synthetic polypeptide
GSIRQTYTLDVLERCPHRPILQAGLPANQTAVLGSDVEFH

SEQ ID NO: 824 - protein, 40 aa, Artificial Sequence
  Description of Artificial Sequence: Synthetic polypeptide
CPHRPILQAGLPANQTAVLGSDVEFHCKVYSDAQPHIQWL

SEQ ID NO: 825 - protein, 40 aa, Artificial Sequence
  Description of Artificial Sequence: Synthetic polypeptide
QVTGSSDNEYFYVDFREYEYDLKWEFPRENLEFGKVLESG

SEQ ID NO: 826 - protein, 40 aa, Artificial Sequence
  Description of Artificial Sequence: Synthetic polypeptide
VTGSSDNEYFYVDFREYEYDLKWEFPRENLEFGKVLESGA

SEQ ID NO: 827 - protein, 40 aa, Artificial Sequence
  Description of Artificial Sequence: Synthetic polypeptide
TGSSDNEYFYVDFREYEYDLKWEFPRENLEFGKVLESGAF

SEQ ID NO: 828 - protein, 40 aa, Artificial Sequence
  Description of Artificial Sequence: Synthetic polypeptide
GSSDNEYFYVDFREYEYDLKWEFPRENLEFGKVLESGAFG

SEQ ID NO: 829 - protein, 40 aa, Artificial Sequence
  Description of Artificial Sequence: Synthetic polypeptide
SSDNEYFYVDFREYEYDLKWEFPRENLEFGKVLESGAFGK

SEQ ID NO: 830 - protein, 40 aa, Artificial Sequence
  Description of Artificial Sequence: Synthetic polypeptide
SDNEYFYVDFREYEYDLKWEFPRENLEFGKVLESGAFGKV

SEQ ID NO: 831 - protein, 40 aa, Artificial Sequence
  Description of Artificial Sequence: Synthetic polypeptide
DNEYFYVDFREYEYDLKWEFPRENLEFGKVLESGAFGKVM

SEQ ID NO: 832 - protein, 40 aa, Artificial Sequence
  Description of Artificial Sequence: Synthetic polypeptide
FYVDFREYEYDLKWEFPRENLEFGKVLESGAFGKVMNATA

SEQ ID NO: 833 - protein, 40 aa, Artificial Sequence
  Description of Artificial Sequence: Synthetic polypeptide
FREYEYDLKWEFPRENLEFGKVLESGAFGKVMNATAYGIS

SEQ ID NO: 834 - protein, 40 aa, Artificial Sequence
  Description of Artificial Sequence: Synthetic polypeptide
EYEYDLKWEFPRENLEFGKVLESGAFGKVMNATAYGISKT

SEQ ID NO: 835 - protein, 40 aa, Artificial Sequence
  Description of Artificial Sequence: Synthetic polypeptide
KWEFPRENLEFGKVLESGAFGKVMNATAYGISKTGVSIQV

SEQ ID NO: 836 - protein, 40 aa, Artificial Sequence
  Description of Artificial Sequence: Synthetic polypeptide
FPRENLEFGKVLESGAFGKVMNATAYGISKTGVSIQVAVK

SEQ ID NO: 837 - protein, 40 aa, Artificial Sequence
  Description of Artificial Sequence: Synthetic polypeptide
PRENLEFGKVLESGAFGKVMNATAYGISKTGVSIQVAVKM

SEQ ID NO: 838 - protein, 40 aa, Artificial Sequence
  Description of Artificial Sequence: Synthetic polypeptide
RENLEFGKVLESGAFGKVMNATAYGISKTGVSIQVAVKML

SEQ ID NO: 839 - protein, 40 aa, Artificial Sequence
  Description of Artificial Sequence: Synthetic polypeptide
FGKVLESGAFGKVMNATAYGISKTGVSIQVAVKMLKEKAD

SEQ ID NO: 840 - protein, 40 aa, Artificial Sequence
  Description of Artificial Sequence: Synthetic polypeptide
KVLESGAFGKVMNATAYGISKTGVSIQVAVKMLKEKADSS

SEQ ID NO: 841 - protein, 40 aa, Artificial Sequence
  Description of Artificial Sequence: Synthetic polypeptide
QVTGSSDNEYFYVDFREYEYDLKWEFPRENLEFGKVLGLG

SEQ ID NO: 842 - protein, 40 aa, Artificial Sequence
  Description of Artificial Sequence: Synthetic polypeptide
VTGSSDNEYFYVDFREYEYDLKWEFPRENLEFGKVLGLGA

SEQ ID NO: 843 - protein, 40 aa, Artificial Sequence
  Description of Artificial Sequence: Synthetic polypeptide
TGSSDNEYFYVDFREYEYDLKWEFPRENLEFGKVLGLGAF

SEQ ID NO: 844 - protein, 40 aa, Artificial Sequence
  Description of Artificial Sequence: Synthetic polypeptide
GSSDNEYFYVDFREYEYDLKWEFPRENLEFGKVLGLGAFG

SEQ ID NO: 845 - protein, 40 aa, Artificial Sequence
  Description of Artificial Sequence: Synthetic polypeptide
SSDNEYFYVDFREYEYDLKWEFPRENLEFGKVLGLGAFGK

SEQ ID NO: 846 - protein, 40 aa, Artificial Sequence
  Description of Artificial Sequence: Synthetic polypeptide
SDNEYFYVDFREYEYDLKWEFPRENLEFGKVLGLGAFGKV

SEQ ID NO: 847 - protein, 40 aa, Artificial Sequence
  Description of Artificial Sequence: Synthetic polypeptide
DNEYFYVDFREYEYDLKWEFPRENLEFGKVLGLGAFGKVM

SEQ ID NO: 848 - protein, 40 aa, Artificial Sequence
  Description of Artificial Sequence: Synthetic polypeptide
YVDFREYEYDLKWEFPRENLEFGKVLGLGAFGKVMNATAY

SEQ ID NO: 849 - protein, 40 aa, Artificial Sequence
  Description of Artificial Sequence: Synthetic polypeptide
DFREYEYDLKWEFPRENLEFGKVLGLGAFGKVMNATAYGI

SEQ ID NO: 850 - protein, 40 aa, Artificial Sequence
  Description of Artificial Sequence: Synthetic polypeptide
FREYEYDLKWEFPRENLEFGKVLGLGAFGKVMNATAYGIS

SEQ ID NO: 851 - protein, 40 aa, Artificial Sequence
  Description of Artificial Sequence: Synthetic polypeptide
EYEYDLKWEFPRENLEFGKVLGLGAFGKVMNATAYGISKT

SEQ ID NO: 852 - protein, 40 aa, Artificial Sequence
  Description of Artificial Sequence: Synthetic polypeptide
EYDLKWEFPRENLEFGKVLGLGAFGKVMNATAYGISKTGV

SEQ ID NO: 853 - protein, 40 aa, Artificial Sequence
  Description of Artificial Sequence: Synthetic polypeptide
WEFPRENLEFGKVLGLGAFGKVMNATAYGISKTGVSIQVA

SEQ ID NO: 854 - protein, 40 aa, Artificial Sequence
  Description of Artificial Sequence: Synthetic polypeptide
LGLGAFGKVMNATAYGISKTGVSIQVAVKMLKEKADSSER

SEQ ID NO: 855 - protein, 40 aa, Artificial Sequence
  Description of Artificial Sequence: Synthetic polypeptide
LGAFGKVMNATAYGISKTGVSIQVAVKMLKEKADSSEREA

SEQ ID NO: 856 - protein, 40 aa, Artificial Sequence
  Description of Artificial Sequence: Synthetic polypeptide
PILVELDGDVNGHKFSVSGEGEGDATYGKLTLKFICTTGK

SEQ ID NO: 857 - protein, 40 aa, Artificial Sequence
  Description of Artificial Sequence: Synthetic polypeptide
YVQERTIFFKDDGNYKTRAEVKFEGDTLVNRIELKGIDFK

SEQ ID NO: 858 - protein, 40 aa, Artificial Sequence
  Description of Artificial Sequence: Synthetic polypeptide
RIELKGIDFKEDGNILGHKLEYNYNSHNVYIMADKQKNGI

SEQ ID NO: 859 - protein, 40 aa, Artificial Sequence
  Description of Artificial Sequence: Synthetic polypeptide
TQQDVLRVCVPTTGIIEYPFDLENIIFRMVDVGGQRSERR

SEQ ID NO: 860 - protein, 40 aa, Artificial Sequence
  Description of Artificial Sequence: Synthetic polypeptide
RVCVPTTGIIEYPFDLENIIFRMVDVGGQRSERRKWIHCF

SEQ ID NO: 861 - protein, 40 aa, Artificial Sequence
  Description of Artificial Sequence: Synthetic polypeptide
VCVPTTGIIEYPFDLENIIFRMVDVGGQRSERRKWIHCFE

SEQ ID NO: 862 - protein, 40 aa, Artificial Sequence
  Description of Artificial Sequence: Synthetic polypeptide
CVPTTGIIEYPFDLENIIFRMVDVGGQRSERRKWIHCFEN

SEQ ID NO: 863 - protein, 40 aa, Artificial Sequence
  Description of Artificial Sequence: Synthetic polypeptide
YPFDLENIIFRMVDVGGHRSERRKWIHCFENVTSIMFLVA

SEQ ID NO: 864 - protein, 40 aa, Artificial Sequence
  Description of Artificial Sequence: Synthetic polypeptide
DVGGPRSERRKWIHCFENVTSIMFLVALSEYDQVLVESDN

SEQ ID NO: 865 - protein, 40 aa, Artificial Sequence
  Description of Artificial Sequence: Synthetic polypeptide
VTSIMFLVALSEYDQVLVESDNENGMEESKALFRTIITYP

SEQ ID NO: 866 - protein, 40 aa, Artificial Sequence
  Description of Artificial Sequence: Synthetic polypeptide
GMEESKALFRTIITYPWFQNSSVILFLNKKDLLEEKIMYS

SEQ ID NO: 867 - protein, 40 aa, Artificial Sequence
  Description of Artificial Sequence: Synthetic polypeptide
ATRSPGVVISDDEPGYDLDLFCIPNHYAEDLERVFIPHGL

SEQ ID NO: 868 - protein, 40 aa, Artificial Sequence
  Description of Artificial Sequence: Synthetic polypeptide
FIPHGLIMDRTERLARDVMKEMGGHHIVALCVLKGGYKFF

SEQ ID NO: 869 - protein, 40 aa, Artificial Sequence
  Description of Artificial Sequence: Synthetic polypeptide
HHIVALCVLKGGYKFFADLLDYIKALNRNSDRSIPMTVDF

SEQ ID NO: 870 - protein, 40 aa, Artificial Sequence
  Description of Artificial Sequence: Synthetic polypeptide
CVLKGGYKFFADLLDYIKALNRNSDRSIPMTVDFIRLKSY

SEQ ID NO: 871 - protein, 40 aa, Artificial Sequence
  Description of Artificial Sequence: Synthetic polypeptide
DRSIPMTVDFIRLKSYCNDQSTGDIKVIGGDDLSTLTGKN

SEQ ID NO: 872 - protein, 40 aa, Artificial Sequence
  Description of Artificial Sequence: Synthetic polypeptide
DFIRLKSYCNDQSTGDIKVIGGDDLSTLTGKNVLIVEDII

SEQ ID NO: 873 - protein, 40 aa, Artificial Sequence
  Description of Artificial Sequence: Synthetic polypeptide
ASLLVKRTPRSVGYKPDFVGFEIPDKFVVGYALDYNEYFR

SEQ ID NO: 874 - protein, 40 aa, Artificial Sequence
  Description of Artificial Sequence: Synthetic polypeptide
LVKRTPRSVGYKPDFVGFEIPDKFVVGYALDYNEYFRDLN

SEQ ID NO: 875 - protein, 40 aa, Artificial Sequence
  Description of Artificial Sequence: Synthetic polypeptide
VKRTPRSVGYKPDFVGFEIPDKFVVGYALDYNEYFRDLNH

SEQ ID NO: 876 - protein, 40 aa, Artificial Sequence
  Description of Artificial Sequence: Synthetic polypeptide
SDDVPMVLVGNNCDLAARTVESRQAQDLARSYGIPYIETS

SEQ ID NO: 877 - protein, 40 aa, Artificial Sequence
  Description of Artificial Sequence: Synthetic polypeptide
DDVPMVLVGNNCDLAARTVESRQAQDLARSYGIPYIETSA

SEQ ID NO: 878 - protein, 40 aa, Artificial Sequence
  Description of Artificial Sequence: Synthetic polypeptide
VFAINNTKSFEDIHQYREQIKRVKDSDDVPMVLVGNRCDL

SEQ ID NO: 879 - protein, 40 aa, Artificial Sequence
  Description of Artificial Sequence: Synthetic polypeptide
GARGVGKSALTIQLIQNHFVDEYDPTIEDSYRKQVVIDGE

SEQ ID NO: 880 - protein, 40 aa, Artificial Sequence
  Description of Artificial Sequence: Synthetic polypeptide
TEYKLVVVGAVGVGKSALTIQLIQNHFVDEYDPTIEDSYR

SEQ ID NO: 881 - protein, 40 aa, Artificial Sequence
  Description of Artificial Sequence: Synthetic polypeptide
KLVVVGAVGVGKSALTIQLIQNHFVDEYDPTIEDSYRKQV

SEQ ID NO: 882 - protein, 40 aa, Artificial Sequence
  Description of Artificial Sequence: Synthetic polypeptide
LVVVGAGRVGKSALTIQLIQNHFVDEYDPTIEDSYRKQVV

SEQ ID NO: 883 - protein, 40 aa, Artificial Sequence
  Description of Artificial Sequence: Synthetic polypeptide
VGAGRVGKSALTIQLIQNHFVDEYDPTIEDSYRKQVVIDG

SEQ ID NO: 884 - protein, 40 aa, Artificial Sequence
  Description of Artificial Sequence: Synthetic polypeptide
GAGVVGKSALTIQLIQNHFVDEYDPTIEDSYRKQVVIDGE

SEQ ID NO: 885 - protein, 40 aa, Artificial Sequence
  Description of Artificial Sequence: Synthetic polypeptide
QNHFVDEYDPTIEDSYRKQVVIDGETCLLDILDTTGQEEY

SEQ ID NO: 886 - protein, 40 aa, Artificial Sequence
  Description of Artificial Sequence: Synthetic polypeptide
FVDEYDPTIEDSYRKQVVIDGETCLLDILDTTGQEEYSAM

SEQ ID NO: 887 - protein, 40 aa, Artificial Sequence
  Description of Artificial Sequence: Synthetic polypeptide
ILDTTGQEEYSAMRDQYMRTGEGFLCVFAINNTKSFEDIH

SEQ ID NO: 888 - protein, 40 aa, Artificial Sequence
  Description of Artificial Sequence: Synthetic polypeptide
TTGQEEYSAMRDQYMRTGEGFLCVFAINNTKSFEDIHQYR

SEQ ID NO: 889 - protein, 40 aa, Artificial Sequence
  Description of Artificial Sequence: Synthetic polypeptide
FVDEYDPTIEDSYRKQVVIDGETCLLDILDTAVQEEYSAM

SEQ ID NO: 890 - protein, 40 aa, Artificial Sequence
  Description of Artificial Sequence: Synthetic polypeptide
DGETCLLDILDTAVQEEYSAMRDQYMRTGEGFLCVFAINN

SEQ ID NO: 891 - protein, 40 aa, Artificial Sequence
  Description of Artificial Sequence: Synthetic polypeptide
ILDTAVQEEYSAMRDQYMRTGEGFLCVFAINNTKSFEDIH

SEQ ID NO: 892 - protein, 40 aa, Artificial Sequence
  Description of Artificial Sequence: Synthetic polypeptide
LDILDTAGKEEYSAMRDQYMRTGEGFLCVFAINNTKSFED

SEQ ID NO: 893 - protein, 40 aa, Artificial Sequence
  Description of Artificial Sequence: Synthetic polypeptide
HFVDEYDPTIEDSYRKQVVIDGETCLLDILDTAGLEEYSA

SEQ ID NO: 894 - protein, 40 aa, Artificial Sequence
  Description of Artificial Sequence: Synthetic polypeptide
ILDTAGLEEYSAMRDQYMRTGEGFLCVFAINNTKSFEDIH

SEQ ID NO: 895 - protein, 40 aa, Artificial Sequence
  Description of Artificial Sequence: Synthetic polypeptide
VFREAIICKNIPRLVSGWVKPIIIGCHAYGDQYRATDFVV

SEQ ID NO: 896 - protein, 40 aa, Artificial Sequence
  Description of Artificial Sequence: Synthetic polypeptide
LVSGWVKPIIIGCHAYGDQYRATDFVVPGPGKVEITYTPS

SEQ ID NO: 897 - protein, 40 aa, Artificial Sequence
  Description of Artificial Sequence: Synthetic polypeptide
VSGWVKPIIIGCHAYGDQYRATDFVVPGPGKVEITYTPSD

SEQ ID NO: 898 - protein, 40 aa, Artificial Sequence
  Description of Artificial Sequence: Synthetic polypeptide
WVKPIIIGHHAYGDQYRATDFVVPGPGKVEITYTPSDGTQ

SEQ ID NO: 899 - protein, 40 aa, Artificial Sequence
  Description of Artificial Sequence: Synthetic polypeptide
KYSVAVKCATITPDEARVEEFKLKKMWKSPNETIRNILGG

SEQ ID NO: 900 - protein, 40 aa, Artificial Sequence
  Description of Artificial Sequence: Synthetic polypeptide
GGHAHGDQYKATDFVADRAGTFKMVFTPKDGSGVKEWEVY

SEQ ID NO: 901 - protein, 40 aa, Artificial Sequence
  Description of Artificial Sequence: Synthetic polypeptide
EPIICKNIPRLVPGWTKPITIGKHAHGDQYKATDFVADRA

SEQ ID NO: 902 - protein, 40 aa, Artificial Sequence
  Description of Artificial Sequence: Synthetic polypeptide
PGWTKPITIGKHAHGDQYKATDFVADRAGTFKMVFTPKDG

SEQ ID NO: 903 - protein, 40 aa, Artificial Sequence
  Description of Artificial Sequence: Synthetic polypeptide
GKHAHGDQYKATDFVADRAGTFKMVFTPKDGSGVKEWEVY

SEQ ID NO: 904 - protein, 40 aa, Artificial Sequence
  Description of Artificial Sequence: Synthetic polypeptide
IGSHAHGDQYKATDFVADRAGTFKMVFTPKDGSGVKEWEV

SEQ ID NO: 905 - protein, 40 aa, Artificial Sequence
  Description of Artificial Sequence: Synthetic polypeptide
SHAHGDQYKATDFVADRAGTFKMVFTPKDGSGVKEWEVYN

SEQ ID NO: 906 - protein, 40 aa, Artificial Sequence
  Description of Artificial Sequence: Synthetic polypeptide
VVSIEGIHPKVMERLIEFAYTASISMGEKCALHVMNGAVM

SEQ ID NO: 907 - protein, 40 aa, Artificial Sequence
  Description of Artificial Sequence: Synthetic polypeptide
QVMPCRAPKVGRLIYTAGDYFRQSLSYLEAYNPSDGTWLR

SEQ ID NO: 908 - protein, 40 aa, Artificial Sequence
  Description of Artificial Sequence: Synthetic polypeptide
CRAPKVGRLIYTAGDYFRQSLSYLEAYNPSDGTWLRLADL

SEQ ID NO: 909 - protein, 40 aa, Artificial Sequence
  Description of Artificial Sequence: Synthetic polypeptide
QVMPCRAPKVGRLIYTAGSYFRQSLSYLEAYNPSDGTWLR

SEQ ID NO: 910 - protein, 40 aa, Artificial Sequence
  Description of Artificial Sequence: Synthetic polypeptide
QWSPCAPMSVPHNRIGVGVIDGHIYAVGGSHGCIHHNSVE

SEQ ID NO: 911 - protein, 40 aa, Artificial Sequence
  Description of Artificial Sequence: Synthetic polypeptide
HNRIGVGVIDGHIYAVGGSHGCIHHNSVERYEPERDEWHL

SEQ ID NO: 912 - protein, 40 aa, Artificial Sequence
  Description of Artificial Sequence: Synthetic polypeptide
LTRRIGVGVAVLNRLLYAVGSFDGTNRLNSAECYYPERNE

SEQ ID NO: 913 - protein, 40 aa, Artificial Sequence
  Description of Artificial Sequence: Synthetic polypeptide
RRIGVGVAVLNRLLYAVGSFDGTNRLNSAECYYPERNEWR

SEQ ID NO: 914 - protein, 40 aa, Artificial Sequence
  Description of Artificial Sequence: Synthetic polypeptide
AVGSFDGTNRLNSAECYYPERNEWRMITAMNTIRSGAGVC

SEQ ID NO: 915 - protein, 40 aa, Artificial Sequence
  Description of Artificial Sequence: Synthetic polypeptide
APMLTRRIGVGVAVLNRLLYAVGGFDGTNCLNSAECYYPE

SEQ ID NO: 916 - protein, 40 aa, Artificial Sequence
  Description of Artificial Sequence: Synthetic polypeptide
TRRIGVGVAVLNRLLYAVGGFDGTNCLNSAECYYPERNEW

SEQ ID NO: 917 - protein, 40 aa, Artificial Sequence
  Description of Artificial Sequence: Synthetic polypeptide
PERNEWRMITAMNTIRSGAGVCVLHNCIYAAGCYDGQDQL

SEQ ID NO: 918 - protein, 40 aa, Artificial Sequence
  Description of Artificial Sequence: Synthetic polypeptide
AECYYPERNEWRMITAMNTIRSGAGVCVLHNCIYAAGGCD

SEQ ID NO: 919 - protein, 40 aa, Artificial Sequence
  Description of Artificial Sequence: Synthetic polypeptide
IRSGAGVCVLHNCIYAAGGCDGQDQLNSVERYDVETETWT

SEQ ID NO: 920 - protein, 40 aa, Artificial Sequence
  Description of Artificial Sequence: Synthetic polypeptide
RSGAGVCVLHNCIYAAGGCDGQDQLNSVERYDVETETWTF

SEQ ID NO: 921 - protein, 40 aa, Artificial Sequence
  Description of Artificial Sequence: Synthetic polypeptide
IYVLGDYDGHTFLDSVECYDPDTDTWSEVTRMTSGRSGVG

SEQ ID NO: 922 - protein, 40 aa, Artificial Sequence
  Description of Artificial Sequence: Synthetic polypeptide
LIGFVIVAGMMCIIVMILTYKYLQKPMYEVQWKGVEEING

SEQ ID NO: 923 - protein, 40 aa, Artificial Sequence
  Description of Artificial Sequence: Synthetic polypeptide
FVIVAGMMCIIVMILTYKYLQKPMYEVQWKGVEEINGNNY

SEQ ID NO: 924 - protein, 40 aa, Artificial Sequence
  Description of Artificial Sequence: Synthetic polypeptide
VMILTYKYLQKPMYEVQWKGVEEINGNNYVYIDPTQLPYD

SEQ ID NO: 925 - protein, 40 aa, Artificial Sequence
  Description of Artificial Sequence: Synthetic polypeptide
QKPMYEVQWKGVEEINGNNYVYIDPTQLPYDHKWEFPRNR

SEQ ID NO: 926 - protein, 40 aa, Artificial Sequence
  Description of Artificial Sequence: Synthetic polypeptide
MMCIIVMILTYKYLQKPMYEVQWKVVEEINGNNYVYIDQT

SEQ ID NO: 927 - protein, 40 aa, Artificial Sequence
  Description of Artificial Sequence: Synthetic polypeptide
IVMILTYKYLQKPMYEVQWKVVEEINGNNYVYIDQTQLPY

SEQ ID NO: 928 - protein, 40 aa, Artificial Sequence
  Description of Artificial Sequence: Synthetic polypeptide
TYKYLQKPMYEVQWKVVEEINGNNYVYIDQTQLPYDHKWE

SEQ ID NO: 929 - protein, 40 aa, Artificial Sequence
  Description of Artificial Sequence: Synthetic polypeptide
KYLQKPMYEVQWKVVEEINGNNYVYIDQTQLPYDHKWEFP

SEQ ID NO: 930 - protein, 40 aa, Artificial Sequence
  Description of Artificial Sequence: Synthetic polypeptide
QKPMYEVQWKVVEEINGNNYVYIDQTQLPYDHKWEFPRNR

SEQ ID NO: 931 - protein, 40 aa, Artificial Sequence
  Description of Artificial Sequence: Synthetic polypeptide
INGNNYVYIDQTQLPYDHKWEFPRNRLSFGKTLGAGAFGK

SEQ ID NO: 932 - protein, 40 aa, Artificial Sequence
  Description of Artificial Sequence: Synthetic polypeptide
MILTYKYLQKPMYEVQWKVVEEINGNNYVYIDPTQPPYDH

SEQ ID NO: 933 - protein, 40 aa, Artificial Sequence
  Description of Artificial Sequence: Synthetic polypeptide
LIKSDAAMTVAVKMLKPSAHLTEREVLMSELKVLSYLGNH

SEQ ID NO: 934 - protein, 40 aa, Artificial Sequence
  Description of Artificial Sequence: Synthetic polypeptide
MTVAVKMLKPSAHLTEREVLMSELKVLSYLGNHMNIVNLL

SEQ ID NO: 935 - protein, 40 aa, Artificial Sequence
  Description of Artificial Sequence: Synthetic polypeptide
FGKVVEATAYGLIKSDAAMTVAVKMLKPSAHLTEREAHMS

SEQ ID NO: 936 - protein, 40 aa, Artificial Sequence
  Description of Artificial Sequence: Synthetic polypeptide
IKSDAAMTVAVKMLKPSAHLTEREAHMSELKVLSYLGNHM

SEQ ID NO: 937 - protein, 40 aa, Artificial Sequence
  Description of Artificial Sequence: Synthetic polypeptide
KSDAAMTVAVKMLKPSAHLTEREAHMSELKVLSYLGNHMN

SEQ ID NO: 938 - protein, 40 aa, Artificial Sequence
  Description of Artificial Sequence: Synthetic polypeptide
AMTVAVKMLKPSAHLTEREAHMSELKVLSYLGNHMNIVNL

SEQ ID NO: 939 - protein, 40 aa, Artificial Sequence
  Description of Artificial Sequence: Synthetic polypeptide
MTVAVKMLKPSAHLTEREAHMSELKVLSYLGNHMNIVNLL

SEQ ID NO: 940 - protein, 40 aa, Artificial Sequence
  Description of Artificial Sequence: Synthetic polypeptide
AVKMLKPSAHLTEREAHMSELKVLSYLGNHMNIVNLLGAC

SEQ ID NO: 941 - protein, 40 aa, Artificial Sequence
  Description of Artificial Sequence: Synthetic polypeptide
MLKPSAHLTEREAHMSELKVLSYLGNHMNIVNLLGACTIG

SEQ ID NO: 942 - protein, 40 aa, Artificial Sequence
  Description of Artificial Sequence: Synthetic polypeptide
AHMSELKVLSYLGNHMNIVNLLGACTIGGPTLVITEYCCY

SEQ ID NO: 943 - protein, 40 aa, Artificial Sequence
  Description of Artificial Sequence: Synthetic polypeptide
ATAYGLIKSDAAMTVAVKMLKPSAHLTEREALMSELEVLS

SEQ ID NO: 944 - protein, 40 aa, Artificial Sequence
  Description of Artificial Sequence: Synthetic polypeptide
KSDAAMTVAVKMLKPSAHLTEREALMSELEVLSYLGNHMN

SEQ ID NO: 945 - protein, 40 aa, Artificial Sequence
  Description of Artificial Sequence: Synthetic polypeptide
MTVAVKMLKPSAHLTEREALMSELEVLSYLGNHMNIVNLL

SEQ ID NO: 946 - protein, 40 aa, Artificial Sequence
  Description of Artificial Sequence: Synthetic polypeptide
EREALMSELEVLSYLGNHMNIVNLLGACTIGGPTLVITEY

SEQ ID NO: 947 - protein, 40 aa, Artificial Sequence
  Description of Artificial Sequence: Synthetic polypeptide
REALMSELEVLSYLGNHMNIVNLLGACTIGGPTLVITEYC

SEQ ID NO: 948 - protein, 40 aa, Artificial Sequence
  Description of Artificial Sequence: Synthetic polypeptide
LEVLSYLGNHMNIVNLLGACTIGGPTLVITEYCCYGDLLN

SEQ ID NO: 949 - protein, 40 aa, Artificial Sequence
  Description of Artificial Sequence: Synthetic polypeptide
FGLARVIKNDSNYVVKGNARLPVKWMAPESIFNCVYTFES

SEQ ID NO: 950 - protein, 40 aa, Artificial Sequence
  Description of Artificial Sequence: Synthetic polypeptide
LARYIKNDSNYVVKGNARLPVKWMAPESIFNCVYTFESDV

SEQ ID NO: 951 - protein, 40 aa, Artificial Sequence
  Description of Artificial Sequence: Synthetic polypeptide
QAPERSKEDANCAVCDSPGDLLDQFFCTTCGQHYHGMYLD

SEQ ID NO: 952 - protein, 40 aa, Artificial Sequence
  Description of Artificial Sequence: Synthetic polypeptide
EDANCAVCDSPGDLLDQFFCTTCGQHYHGMYLDIAVTPLK

SEQ ID NO: 953 - protein, 40 aa, Artificial Sequence
  Description of Artificial Sequence: Synthetic polypeptide
ANCAVCDSPGDLLDQFFCTTCGQHYHGMYLDIAVTPLKRA

SEQ ID NO: 954 - protein, 40 aa, Artificial Sequence
  Description of Artificial Sequence: Synthetic polypeptide
VCDSPGDLLDQFFCTTCGQHYHGMYLDIAVTPLKRAGWQC

SEQ ID NO: 955 - protein, 40 aa, Artificial Sequence
  Description of Artificial Sequence: Synthetic polypeptide
PGDLLDQFFCTTCGQHYHGMYLDIAVTPLKRAGWQCPECK

SEQ ID NO: 956 - protein, 40 aa, Artificial Sequence
  Description of Artificial Sequence: Synthetic polypeptide
FFCTTCGQHYHGMYLDIAVTPLKRAGWQCPECKVCQNCKQ

SEQ ID NO: 957 - protein, 40 aa, Artificial Sequence
  Description of Artificial Sequence: Synthetic polypeptide
QHYHGMYLDIAVTPLKRAGWQCPECKVCQNCKQSGEDSKM

SEQ ID NO: 958 - protein, 40 aa, Artificial Sequence
  Description of Artificial Sequence: Synthetic polypeptide
SPGDLLDQFFCTTCGQHYHGMCLDIAVTPLKRAGWQYPEC

SEQ ID NO: 959 - protein, 40 aa, Artificial Sequence
  Description of Artificial Sequence: Synthetic polypeptide
DLLDQFFCTTCGQHYHGMCLDIAVTPLKRAGWQYPECKVC

SEQ ID NO: 960 - protein, 40 aa, Artificial Sequence
  Description of Artificial Sequence: Synthetic polypeptide
CGQHYHGMCLDIAVTPLKRAGWQYPECKVCQNCKQSGEDS

SEQ ID NO: 961 - protein, 40 aa, Artificial Sequence
  Description of Artificial Sequence: Synthetic polypeptide
WQYPECKVCQNCKQSGEDSKMLVCDTCDKGYHTFCLQPVM

SEQ ID NO: 962 - protein, 40 aa, Artificial Sequence
  Description of Artificial Sequence: Synthetic polypeptide
FLCVFAINNTKSFEDIHHYREQIKRVKDSEDVPMVLVGNN

SEQ ID NO: 963 - protein, 40 aa, Artificial Sequence
  Description of Artificial Sequence: Synthetic polypeptide
LCVFAINNTKSFEDIHHYREQIKRVKDSEDVPMVLVGNNC

SEQ ID NO: 964 - protein, 40 aa, Artificial Sequence
  Description of Artificial Sequence: Synthetic polypeptide
CVFAINNTKSFEDIHHYREQIKRVKDSEDVPMVLVGNNCD

SEQ ID NO: 965 - protein, 40 aa, Artificial Sequence
  Description of Artificial Sequence: Synthetic polypeptide
VFAINNTKSFEDIHHYREQIKRVKDSEDVPMVLVGNNCDL

SEQ ID NO: 966 - protein, 40 aa, Artificial Sequence
  Description of Artificial Sequence: Synthetic polypeptide
FAINNTKSFEDIHHYREQIKRVKDSEDVPMVLVGNNCDLP

SEQ ID NO: 967 - protein, 40 aa, Artificial Sequence
  Description of Artificial Sequence: Synthetic polypeptide
AINNTKSFEDIHHYREQIKRVKDSEDVPMVLVGNNCDLPS

SEQ ID NO: 968 - protein, 40 aa, Artificial Sequence
  Description of Artificial Sequence: Synthetic polypeptide
INNTKSFEDIHHYREQIKRVKDSEDVPMVLVGNNCDLPSR

SEQ ID NO: 969 - protein, 40 aa, Artificial Sequence
  Description of Artificial Sequence: Synthetic polypeptide
NNTKSFEDIHHYREQIKRVKDSEDVPMVLVGNNCDLPSRT

SEQ ID NO: 970 - protein, 40 aa, Artificial Sequence
  Description of Artificial Sequence: Synthetic polypeptide
NTKSFEDIHHYREQIKRVKDSEDVPMVLVGNNCDLPSRTV

SEQ ID NO: 971 - protein, 40 aa, Artificial Sequence
  Description of Artificial Sequence: Synthetic polypeptide
TKSFEDIHHYREQIKRVKDSEDVPMVLVGNNCDLPSRTVD

SEQ ID NO: 972 - protein, 40 aa, Artificial Sequence
  Description of Artificial Sequence: Synthetic polypeptide
KSFEDIHHYREQIKRVKDSEDVPMVLVGNNCDLPSRTVDT

SEQ ID NO: 973 - protein, 40 aa, Artificial Sequence
  Description of Artificial Sequence: Synthetic polypeptide
SFEDIHHYREQIKRVKDSEDVPMVLVGNNCDLPSRTVDTK

SEQ ID NO: 974 - protein, 40 aa, Artificial Sequence
  Description of Artificial Sequence: Synthetic polypeptide
FEDIHHYREQIKRVKDSEDVPMVLVGNNCDLPSRTVDTKQ

SEQ ID NO: 975 - protein, 40 aa, Artificial Sequence
  Description of Artificial Sequence: Synthetic polypeptide
EDIHHYREQIKRVKDSEDVPMVLVGNNCDLPSRTVDTKQA

SEQ ID NO: 976 - protein, 40 aa, Artificial Sequence
  Description of Artificial Sequence: Synthetic polypeptide
DIHHYREQIKRVKDSEDVPMVLVGNNCDLPSRTVDTKQAQ

SEQ ID NO: 977 - protein, 40 aa, Artificial Sequence
  Description of Artificial Sequence: Synthetic polypeptide
IHHYREQIKRVKDSEDVPMVLVGNNCDLPSRTVDTKQAQD

SEQ ID NO: 978 - protein, 40 aa, Artificial Sequence
  Description of Artificial Sequence: Synthetic polypeptide
HHYREQIKRVKDSEDVPMVLVGNNCDLPSRTVDTKQAQDL

SEQ ID NO: 979 - protein, 40 aa, Artificial Sequence
  Description of Artificial Sequence: Synthetic polypeptide
YREQIKRVKDSEDVPMVLVGNNCDLPSRTVDTKQAQDLAR

SEQ ID NO: 980 - protein, 40 aa, Artificial Sequence
  Description of Artificial Sequence: Synthetic polypeptide
REQIKRVKDSEDVPMVLVGNNCDLPSRTVDTKQAQDLARS

SEQ ID NO: 981 - protein, 40 aa, Artificial Sequence
  Description of Artificial Sequence: Synthetic polypeptide
RVKDSEDVPMVLVGNNCDLPSRTVDTKQAQDLARSYGIPF

SEQ ID NO: 982 - protein, 40 aa, Artificial Sequence
  Description of Artificial Sequence: Synthetic polypeptide
VVGARGVGKSALTIQLIQNHFVDEYDPTIEDSYRKQVVID

SEQ ID NO: 983 - protein, 40 aa, Artificial Sequence; identical to SEQ ID NO: 880
  Description of Artificial Sequence: Synthetic polypeptide

SEQ ID NO: 984 - protein, 40 aa, Artificial Sequence
  Description of Artificial Sequence: Synthetic polypeptide
TEYKLVVVGAGGIGKSALTIQLIQNHFVDEYDPTIEDSYR

SEQ ID NO: 985 - protein, 40 aa, Artificial Sequence
  Description of Artificial Sequence: Synthetic polypeptide
YKLVVVGAGGIGKSALTIQLIQNHFVDEYDPTIEDSYRKQ

SEQ ID NO: 986 - protein, 40 aa, Artificial Sequence
  Description of Artificial Sequence: Synthetic polypeptide
GKSAFTIQLIQNHFVDEYDPTIEDSYRKQVVIDGETCLLD

SEQ ID NO: 987 - protein, 40 aa, Artificial Sequence
  Description of Artificial Sequence: Synthetic polypeptide
AFTIQLIQNHFVDEYDPTIEDSYRKQVVIDGETCLLDILD

SEQ ID NO: 988 - protein, 40 aa, Artificial Sequence
  Description of Artificial Sequence: Synthetic polypeptide
LVVVGAGGVGKSALRIQLIQNHFVDEYDPTIEDSYRKQVV

SEQ ID NO: 989 - protein, 40 aa, Artificial Sequence
  Description of Artificial Sequence: Synthetic polypeptide
GKSALTRQLIQNHFVDEYDPTIEDSYRKQVVIDGETCLLD

SEQ ID NO: 990 - protein, 40 aa, Artificial Sequence
  Description of Artificial Sequence: Synthetic polypeptide
TEYKLVVVGAGGVGKSALTIQLIQNHFVDEYDLTIEDSYR

SEQ ID NO: 991 - protein, 40 aa, Artificial Sequence
  Description of Artificial Sequence: Synthetic polypeptide
KLVVVGAGGVGKSALTIQLIQNHFVDEYDLTIEDSYRKQV

SEQ ID NO: 992 - protein, 40 aa, Artificial Sequence
  Description of Artificial Sequence: Synthetic polypeptide
VVGAGGVGKSALTIQLIQNHFVDEYDLTIEDSYRKQVVID

SEQ ID NO: 993 - protein, 40 aa, Artificial Sequence
  Description of Artificial Sequence: Synthetic polypeptide
ALTIQLIQNHFVDEYDLTIEDSYRKQVVIDGETCLLDILD

SEQ ID NO: 994 - protein, 40 aa, Artificial Sequence
  Description of Artificial Sequence: Synthetic polypeptide
VDEYDLTIEDSYRKQVVIDGETCLLDILDTAGQEEYSAMR

SEQ ID NO: 995 - protein, 40 aa, Artificial Sequence
  Description of Artificial Sequence: Synthetic polypeptide
VDEYDPTIEDSYRKQVVIDGETCLLDILDTGGQEEYSAMR

SEQ ID NO: 996 - protein, 40 aa, Artificial Sequence
  Description of Artificial Sequence: Synthetic polypeptide
IDGETCLLDILDTGGQEEYSAMRDQYMRTGEGFLCVFAIN

SEQ ID NO: 997 - protein, 40 aa, Artificial Sequence
  Description of Artificial Sequence: Synthetic polypeptide
CLLDILDTGGQEEYSAMRDQYMRTGEGFLCVFAINNTKSF

SEQ ID NO: 998 - protein, 40 aa, Artificial Sequence
  Description of Artificial Sequence: Synthetic polypeptide
LDTGGQEEYSAMRDQYMRTGEGFLCVFAINNTKSFEDIHH

SEQ ID NO: 999 - protein, 40 aa, Artificial Sequence
  Description of Artificial Sequence: Synthetic polypeptide
TGGQEEYSAMRDQYMRTGEGFLCVFAINNTKSFEDIHHYR

SEQ ID NO: 1000 - protein, 40 aa, Artificial Sequence
  Description of Artificial Sequence: Synthetic polypeptide
NHFVDEYDPTIEDSYRKQVVIDGETCLLDILDTTGQEEYS

SEQ ID NO: 1001 - protein, 40 aa, Artificial Sequence
  Description of Artificial Sequence: Synthetic polypeptide
VDEYDPTIEDSYRKQVVIDGETCLLDILDTTGQEEYSAMR

SEQ ID NO: 1002 - protein, 40 aa, Artificial Sequence
  Description of Artificial Sequence: Synthetic polypeptide
TCLLDILDTTGQEEYSAMRDQYMRTGEGFLCVFAINNTKS

SEQ ID NO: 1003 - protein, 40 aa, Artificial Sequence
  Description of Artificial Sequence: Synthetic polypeptide
LLDILDTTGQEEYSAMRDQYMRTGEGFLCVFAINNTKSFE

SEQ ID NO: 1004 - protein, 40 aa, Artificial Sequence
  Description of Artificial Sequence: Synthetic polypeptide
TTGQEEYSAMRDQYMRTGEGFLCVFAINNTKSFEDIHHYR

SEQ ID NO: 1005 - protein, 40 aa, Artificial Sequence
  Description of Artificial Sequence: Synthetic polypeptide
TGQEEYSAMRDQYMRTGEGFLCVFAINNTKSFEDIHHYRE

SEQ ID NO: 1006 - protein, 40 aa, Artificial Sequence
  Description of Artificial Sequence: Synthetic polypeptide
QLIQNHFVDEYDPTIEDSYRKQVVIDGETCLLDILDTAGK

SEQ ID NO: 1007 - protein, 40 aa, Artificial Sequence
  Description of Artificial Sequence: Synthetic polypeptide
LIQNHFVDEYDPTIEDSYRKQVVIDGETCLLDILDTAGKE

SEQ ID NO: 1008 - protein, 40 aa, Artificial Sequence
  Description of Artificial Sequence: Synthetic polypeptide
IQNHFVDEYDPTIEDSYRKQVVIDGETCLLDILDTAGKEE

SEQ ID NO: 1009 - protein, 40 aa, Artificial Sequence
  Description of Artificial Sequence: Synthetic polypeptide
NHFVDEYDPTIEDSYRKQVVIDGETCLLDILDTAGKEEYS

SEQ ID NO: 1010 - protein, 40 aa, Artificial Sequence
  Description of Artificial Sequence: Synthetic polypeptide
VDEYDPTIEDSYRKQVVIDGETCLLDILDTAGKEEYSAMR

SEQ ID NO: 1011 - protein, 40 aa, Artificial Sequence
  Description of Artificial Sequence: Synthetic polypeptide
TIEDSYRKQVVIDGETCLLDILDTAGKEEYSAMRDQYMRT

SEQ ID NO: 1012 - protein, 40 aa, Artificial Sequence
  Description of Artificial Sequence: Synthetic polypeptide
EDSYRKQVVIDGETCLLDILDTAGKEEYSAMRDQYMRTGE

SEQ ID NO: 1013 - protein, 40 aa, Artificial Sequence
  Description of Artificial Sequence: Synthetic polypeptide
RKQVVIDGETCLLDILDTAGKEEYSAMRDQYMRTGEGFLC

SEQ ID NO: 1014 - protein, 40 aa, Artificial Sequence
  Description of Artificial Sequence: Synthetic polypeptide
KQVVIDGETCLLDILDTAGKEEYSAMRDQYMRTGEGFLCV

SEQ ID NO: 1015 - protein, 40 aa, Artificial Sequence
  Description of Artificial Sequence: Synthetic polypeptide
QVVIDGETCLLDILDTAGKEEYSAMRDQYMRTGEGFLCVF

SEQ ID NO: 1016 - protein, 40 aa, Artificial Sequence
  Description of Artificial Sequence: Synthetic polypeptide
VVIDGETCLLDILDTAGKEEYSAMRDQYMRTGEGFLCVFA

SEQ ID NO: 1017 - protein, 40 aa, Artificial Sequence
  Description of Artificial Sequence: Synthetic polypeptide
DGETCLLDILDTAGKEEYSAMRDQYMRTGEGFLCVFAINN

SEQ ID NO: 1018 - protein, 40 aa, Artificial Sequence
  Description of Artificial Sequence: Synthetic polypeptide
CLLDILDTAGKEEYSAMRDQYMRTGEGFLCVFAINNTKSF

SEQ ID NO: 1019 - protein, 40 aa, Artificial Sequence
  Description of Artificial Sequence: Synthetic polypeptide
LLDILDTAGKEEYSAMRDQYMRTGEGFLCVFAINNTKSFE

SEQ ID NO: 1020 - protein, 40 aa, Artificial Sequence
  Description of Artificial Sequence: Synthetic polypeptide
ILDTAGKEEYSAMRDQYMRTGEGFLCVFAINNTKSFEDIH

SEQ ID NO: 1021 - protein, 40 aa, Artificial Sequence
  Description of Artificial Sequence: Synthetic polypeptide
DTAGKEEYSAMRDQYMRTGEGFLCVFAINNTKSFEDIHHY

SEQ ID NO: 1022 - protein, 40 aa, Artificial Sequence
  Description of Artificial Sequence: Synthetic polypeptide
TAGKEEYSAMRDQYMRTGEGFLCVFAINNTKSFEDIHHYR

SEQ ID NO: 1023 - protein, 40 aa, Artificial Sequence
  Description of Artificial Sequence: Synthetic polypeptide
KEEYSAMRDQYMRTGEGFLCVFAINNTKSFEDIHHYREQI

SEQ ID NO: 1024 - protein, 40 aa, Artificial Sequence
  Description of Artificial Sequence: Synthetic polypeptide
QLIQNHFVDEYDPTIEDSYRKQVVIDGETCLLDILDTAGR

SEQ ID NO: 1025 - protein, 40 aa, Artificial Sequence
  Description of Artificial Sequence: Synthetic polypeptide
RKQVVIDGETCLLDILDTAGREEYSAMRDQYMRTGEGFLC

SEQ ID NO: 1026 - protein, 40 aa, Artificial Sequence
  Description of Artificial Sequence: Synthetic polypeptide
KQVVIDGETCLLDILDTAGREEYSAMRDQYMRTGEGFLCV

SEQ ID NO: 1027 - protein, 40 aa, Artificial Sequence
  Description of Artificial Sequence: Synthetic polypeptide
VIDGETCLLDILDTAGREEYSAMRDQYMRTGEGFLCVFAI

SEQ ID NO: 1028 - protein, 40 aa, Artificial Sequence
  Description of Artificial Sequence: Synthetic polypeptide
GETCLLDILDTAGREEYSAMRDQYMRTGEGFLCVFAINNT

SEQ ID NO: 1029 - protein, 40 aa, Artificial Sequence
  Description of Artificial Sequence: Synthetic polypeptide
LLDILDTAGREEYSAMRDQYMRTGEGFLCVFAINNTKSFE

SEQ ID NO: 1030 - protein, 40 aa, Artificial Sequence
  Description of Artificial Sequence: Synthetic polypeptide
LDTAGREEYSAMRDQYMRTGEGFLCVFAINNTKSFEDIHH

SEQ ID NO: 1031 - protein, 40 aa, Artificial Sequence
  Description of Artificial Sequence: Synthetic polypeptide
TAGREEYSAMRDQYMRTGEGFLCVFAINNTKSFEDIHHYR

SEQ ID NO: 1032 - protein, 40 aa, Artificial Sequence
  Description of Artificial Sequence: Synthetic polypeptide
AGREEYSAMRDQYMRTGEGFLCVFAINNTKSFEDIHHYRE

SEQ ID NO: 1033 - protein, 40 aa, Artificial Sequence
  Description of Artificial Sequence: Synthetic polypeptide
REEYSAMRDQYMRTGEGFLCVFAINNTKSFEDIHHYREQI

SEQ ID NO: 1034 - protein, 40 aa, Artificial Sequence
  Description of Artificial Sequence: Synthetic polypeptide
VVIDGETCLLDILDTAGQKEYSAMRDQYMRTGEGFLCVFA

SEQ ID NO: 1035 - protein, 40 aa, Artificial Sequence
  Description of Artificial Sequence: Synthetic polypeptide
IDGETCLLDILDTAGQKEYSAMRDQYMRTGEGFLCVFAIN

SEQ ID NO: 1036 - protein, 40 aa, Artificial Sequence
  Description of Artificial Sequence: Synthetic polypeptide
GETCLLDILDTAGQKEYSAMRDQYMRTGEGFLCVFAINNT

SEQ ID NO: 1037 - protein, 40 aa, Artificial Sequence
  Description of Artificial Sequence: Synthetic polypeptide
CLLDILDTAGQKEYSAMRDQYMRTGEGFLCVFAINNTKSF

SEQ ID NO: 1038 - protein, 40 aa, Artificial Sequence
  Description of Artificial Sequence: Synthetic polypeptide
LDILDTAGQKEYSAMRDQYMRTGEGFLCVFAINNTKSFED

SEQ ID NO: 1039 - protein, 40 aa, Artificial Sequence
  Description of Artificial Sequence: Synthetic polypeptide
ILDTAGQKEYSAMRDQYMRTGEGFLCVFAINNTKSFEDIH

SEQ ID NO: 1040 - protein, 40 aa, Artificial Sequence
  Description of Artificial Sequence: Synthetic polypeptide
LDTAGQKEYSAMRDQYMRTGEGFLCVFAINNTKSFEDIHH

SEQ ID NO: 1041 - protein, 40 aa, Artificial Sequence
  Description of Artificial Sequence: Synthetic polypeptide
QKEYSAMRDQYMRTGEGFLCVFAINNTKSFEDIHHYREQI

SEQ ID NO: 1042 - protein, 40 aa, Artificial Sequence
  Description of Artificial Sequence: Synthetic polypeptide
NHFVDEYDPTIEDSYRKQVVIDGETCLLDILDTAGQEKYS

SEQ ID NO: 1043 - protein, 40 aa, Artificial Sequence
  Description of Artificial Sequence: Synthetic polypeptide
FVDEYDPTIEDSYRKQVVIDGETCLLDILDTAGQEKYSAM

SEQ ID NO: 1044 - protein, 40 aa, Artificial Sequence
  Description of Artificial Sequence: Synthetic polypeptide
DPTIEDSYRKQVVIDGETCLLDILDTAGQEKYSAMRDQYM

SEQ ID NO: 1045 - protein, 40 aa, Artificial Sequence
  Description of Artificial Sequence: Synthetic polypeptide
KQVVIDGETCLLDILDTAGQEKYSAMRDQYMRTGEGFLCV

SEQ ID NO: 1046 - protein, 40 aa, Artificial Sequence
  Description of Artificial Sequence: Synthetic polypeptide
DGETCLLDILDTAGQEKYSAMRDQYMRTGEGFLCVFAINN

SEQ ID NO: 1047 - protein, 40 aa, Artificial Sequence
  Description of Artificial Sequence: Synthetic polypeptide
ETCLLDILDTAGQEKYSAMRDQYMRTGEGFLCVFAINNTK

SEQ ID NO: 1048 - protein, 40 aa, Artificial Sequence
  Description of Artificial Sequence: Synthetic polypeptide
TCLLDILDTAGQEKYSAMRDQYMRTGEGFLCVFAINNTKS

SEQ ID NO: 1049 - protein, 40 aa, Artificial Sequence
  Description of Artificial Sequence: Synthetic polypeptide
CLLDILDTAGQEKYSAMRDQYMRTGEGFLCVFAINNTKSF

SEQ ID NO: 1050 - protein, 40 aa, Artificial Sequence
  Description of Artificial Sequence: Synthetic polypeptide
LLDILDTAGQEKYSAMRDQYMRTGEGFLCVFAINNTKSFE

SEQ ID NO: 1051 - protein, 40 aa, Artificial Sequence
  Description of Artificial Sequence: Synthetic polypeptide
TAGQEKYSAMRDQYMRTGEGFLCVFAINNTKSFEDIHHYR

SEQ ID NO: 1052 - protein, 40 aa, Artificial Sequence
  Description of Artificial Sequence: Synthetic polypeptide
QEKYSAMRDQYMRTGEGFLCVFAINNTKSFEDIHHYREQI

SEQ ID NO: 1053 - protein, 40 aa, Artificial Sequence
  Description of Artificial Sequence: Synthetic polypeptide
VLHERNSPYIVGFYGAFYSDGEISICMEHMDGGSLDQVLK

SEQ ID NO: 1054 - protein, 40 aa, Artificial Sequence
  Description of Artificial Sequence: Synthetic polypeptide
MARKLIHLEIKPAIRNQIIRELQVLHECNSLYIVGFYGAF

SEQ ID NO: 1055 - protein, 40 aa, Artificial Sequence
  Description of Artificial Sequence: Synthetic polypeptide
IRELQVLHECNSLYIVGFYGAFYSDGEISICMEHMDGGSL

SEQ ID NO: 1056 - protein, 40 aa, Artificial Sequence
  Description of Artificial Sequence: Synthetic polypeptide
ELQVLHECNSLYIVGFYGAFYSDGEISICMEHMDGGSLDQ

SEQ ID NO: 1057 - protein, 40 aa, Artificial Sequence
  Description of Artificial Sequence: Synthetic polypeptide
CNSLYIVGFYGAFYSDGEISICMEHMDGGSLDQVLKKAGR

SEQ ID NO: 1058 - protein, 40 aa, Artificial Sequence
  Description of Artificial Sequence: Synthetic polypeptide
GLVMARKLIHLEIKPAIRNQIIRELQVLHECNSSYIVGFY

SEQ ID NO: 1059 - protein, 40 aa, Artificial Sequence
  Description of Artificial Sequence: Synthetic polypeptide
NSSYIVGFYGAFYSDGEISICMEHMDGGSLDQVLKKAGRI

SEQ ID NO: 1060 - protein, 40 aa, Artificial Sequence
  Description of Artificial Sequence: Synthetic polypeptide
LIVHFNEVIGRGHFGCVYHGTLLDNDGKKIHCAVISLNRI

SEQ ID NO: 1061 - protein, 40 aa, Artificial Sequence
  Description of Artificial Sequence: Synthetic polypeptide
HFNEVIGRGHFGCVYHGTLLDNDGKKIHCAVISLNRITDI

SEQ ID NO: 1062 - protein, 40 aa, Artificial Sequence
  Description of Artificial Sequence: Synthetic polypeptide
RNCMLDEKFTVKVADFGLARDMYDKEYYSVHNKTGAKLHV

SEQ ID NO: 1063 - protein, 40 aa, Artificial Sequence
  Description of Artificial Sequence: Synthetic polypeptide
MLDEKFTVKVADFGLARDMYDKEYYSVHNKTGAKLHVKWM

SEQ ID NO: 1064 - protein, 40 aa, Artificial Sequence
  Description of Artificial Sequence: Synthetic polypeptide
ADFGLARDMYDKEYYSVHNKTGAKLHVKWMALESLQTQKF

SEQ ID NO: 1065 - protein, 40 aa, Artificial Sequence
  Description of Artificial Sequence: Synthetic polypeptide
MYDKEYYSVHNKTGAKLPVCWMALESLQTQKFTTKSDVWS

SEQ ID NO: 1066 - protein, 40 aa, Artificial Sequence
  Description of Artificial Sequence: Synthetic polypeptide
YDKEYYSVHNKTGAKLPVCWMALESLQTQKFTTKSDVWSF

SEQ ID NO: 1067 - protein, 40 aa, Artificial Sequence
  Description of Artificial Sequence: Synthetic polypeptide
MLDEKFTVKVADFGLARDMYDKEYYSVHNKTGAKLPVHWM

SEQ ID NO: 1068 - protein, 40 aa, Artificial Sequence
  Description of Artificial Sequence: Synthetic polypeptide
VADFGLARDMYDKEYYSVHNKTGAKLPVHWMALESLQTQK

SEQ ID NO: 1069 - protein, 40 aa, Artificial Sequence
  Description of Artificial Sequence: Synthetic polypeptide
ADFGLARDMYDKEYYSVHNKTGAKLPVHWMALESLQTQKF

SEQ ID NO: 1070 - protein, 40 aa, Artificial Sequence
  Description of Artificial Sequence: Synthetic polypeptide
ARDMYDKEYYSVHNKTGAKLPVHWMALESLQTQKFTTKSD

SEQ ID NO: 1071 - protein, 40 aa, Artificial Sequence
  Description of Artificial Sequence: Synthetic polypeptide
RDMYDKEYYSVHNKTGAKLPVHWMALESLQTQKFTTKSDV

SEQ ID NO: 1072 - protein, 40 aa, Artificial Sequence
  Description of Artificial Sequence: Synthetic polypeptide
LTDIGRYHPQALIYPLTVASESTTTARHNAANKILKNMCE

SEQ ID NO: 1073 - protein, 40 aa, Artificial Sequence
  Description of Artificial Sequence: Synthetic polypeptide
LTVASESTTTARHNAANKILKNMCEHSNTLVQQAMMVSEE

SEQ ID NO: 1074 - protein, 40 aa, Artificial Sequence
  Description of Artificial Sequence: Synthetic polypeptide
GSNGHEFVFLLKGHEDLRQDERVMQLFGLVNTLLANDPTF

SEQ ID NO: 1075 - protein, 40 aa, Artificial Sequence
  Description of Artificial Sequence: Synthetic polypeptide
LKGHEDLRQDERVMQLFGLVNTLLANDPTFLRKNLSIQRY

SEQ ID NO: 1076 - protein, 40 aa, Artificial Sequence
  Description of Artificial Sequence: Synthetic polypeptide
EVTGLDGNYRITCHTVMEALREHKDSVMAVLEAFVYDPLL

SEQ ID NO: 1077 - protein, 40 aa, Artificial Sequence
  Description of Artificial Sequence: Synthetic polypeptide
LDGNYRITCHTVMEALREHKDSVMAVLEAFVYDPLLNWRL

SEQ ID NO: 1078 - protein, 40 aa, Artificial Sequence
  Description of Artificial Sequence: Synthetic polypeptide
HTVMEALREHKDSVMAVLEAFVYDPLLNWRLMDTNTKGNK

SEQ ID NO: 1079 - protein, 40 aa, Artificial Sequence
  Description of Artificial Sequence: Synthetic polypeptide
TGLDGNYRITCHTVMEMLREHKDSVMAVLEAFVYDPLLNW

SEQ ID NO: 1080 - protein, 40 aa, Artificial Sequence
  Description of Artificial Sequence: Synthetic polypeptide
DGNYRITCHTVMEMLREHKDSVMAVLEAFVYDPLLNWRLM

SEQ ID NO: 1081 - protein, 40 aa, Artificial Sequence
  Description of Artificial Sequence: Synthetic polypeptide
DFSQRRKEYELEKQKKLEKERQEQLQKEQEKAFFAQLQLG

SEQ ID NO: 1082 - protein, 40 aa, Artificial Sequence
  Description of Artificial Sequence: Synthetic polypeptide
FSQRRKEYELEKQKKLEKERQEQLQKEQEKAFFAQLQLGE

SEQ ID NO: 1083 - protein, 40 aa, Artificial Sequence
  Description of Artificial Sequence: Synthetic polypeptide
SQRRKEYELEKQKKLEKERQEQLQKEQEKAFFAQLQLGEE

SEQ ID NO: 1084 - protein, 40 aa, Artificial Sequence
  Description of Artificial Sequence: Synthetic polypeptide
QRRKEYELEKQKKLEKERQEQLQKEQEKAFFAQLQLGEET

SEQ ID NO: 1085 - protein, 40 aa, Artificial Sequence
  Description of Artificial Sequence: Synthetic polypeptide
RRKEYELEKQKKLEKERQEQLQKEQEKAFFAQLQLGEETG

SEQ ID NO: 1086 - protein, 40 aa, Artificial Sequence
  Description of Artificial Sequence: Synthetic polypeptide
RKEYELEKQKKLEKERQEQLQKEQEKAFFAQLQLGEETGE

SEQ ID NO: 1087 - protein, 40 aa, Artificial Sequence
  Description of Artificial Sequence: Synthetic polypeptide
KEYELEKQKKLEKERQEQLQKEQEKAFFAQLQLGEETGEF

SEQ ID NO: 1088 - protein, 40 aa, Artificial Sequence
  Description of Artificial Sequence: Synthetic polypeptide
EYELEKQKKLEKERQEQLQKEQEKAFFAQLQLGEETGEFL

SEQ ID NO: 1089 - protein, 40 aa, Artificial Sequence
  Description of Artificial Sequence: Synthetic polypeptide
YELEKQKKLEKERQEQLQKEQEKAFFAQLQLGEETGEFLP

SEQ ID NO: 1090 - protein, 40 aa, Artificial Sequence
  Description of Artificial Sequence: Synthetic polypeptide
ELEKQKKLEKERQEQLQKEQEKAFFAQLQLGEETGEFLPI

SEQ ID NO: 1091 - protein, 40 aa, Artificial Sequence
  Description of Artificial Sequence: Synthetic polypeptide
LEKQKKLEKERQEQLQKEQEKAFFAQLQLGEETGEFLPIQ

SEQ ID NO: 1092 - protein, 40 aa, Artificial Sequence
  Description of Artificial Sequence: Synthetic polypeptide
EKQKKLEKERQEQLQKEQEKAFFAQLQLGEETGEFLPIQP

SEQ ID NO: 1093 - protein, 40 aa, Artificial Sequence
  Description of Artificial Sequence: Synthetic polypeptide
KQKKLEKERQEQLQKEQEKAFFAQLQLGEETGEFLPIQPA

SEQ ID NO: 1094 - protein, 40 aa, Artificial Sequence
  Description of Artificial Sequence: Synthetic polypeptide
KERQEQLQKEQEKAFFAQLQLGEETGEFLPIQPAQHIQSE

SEQ ID NO: 1095 - protein, 40 aa, Artificial Sequence
  Description of Artificial Sequence: Synthetic polypeptide
EQLQKEQEKAFFAQLQLGEETGEFLPIQPAQHIQSETSGS

SEQ ID NO: 1096 - protein, 40 aa, Artificial Sequence
  Description of Artificial Sequence: Synthetic polypeptide
SQRRKEYELEKQKKLEKERQEQLQKEQEKAFFAQLQLDEG

SEQ ID NO: 1097 - protein, 40 aa, Artificial Sequence
  Description of Artificial Sequence: Synthetic polypeptide
QRRKEYELEKQKKLEKERQEQLQKEQEKAFFAQLQLDEGT

SEQ ID NO: 1098 - protein, 40 aa, Artificial Sequence
  Description of Artificial Sequence: Synthetic polypeptide
RRKEYELEKQKKLEKERQEQLQKEQEKAFFAQLQLDEGTG

SEQ ID NO: 1099 - protein, 40 aa, Artificial Sequence
  Description of Artificial Sequence: Synthetic polypeptide
RKEYELEKQKKLEKERQEQLQKEQEKAFFAQLQLDEGTGE

SEQ ID NO: 1100 - protein, 40 aa, Artificial Sequence
  Description of Artificial Sequence: Synthetic polypeptide
KEYELEKQKKLEKERQEQLQKEQEKAFFAQLQLDEGTGEF

SEQ ID NO: 1101 - protein, 40 aa, Artificial Sequence
  Description of Artificial Sequence: Synthetic polypeptide
EYELEKQKKLEKERQEQLQKEQEKAFFAQLQLDEGTGEFL

SEQ ID NO: 1102 - protein, 40 aa, Artificial Sequence
  Description of Artificial Sequence: Synthetic polypeptide
YELEKQKKLEKERQEQLQKEQEKAFFAQLQLDEGTGEFLP

SEQ ID NO: 1103 - protein, 40 aa, Artificial Sequence
  Description of Artificial Sequence: Synthetic polypeptide
ELEKQKKLEKERQEQLQKEQEKAFFAQLQLDEGTGEFLPI

SEQ ID NO: 1104 - protein, 40 aa, Artificial Sequence
  Description of Artificial Sequence: Synthetic polypeptide
LEKQKKLEKERQEQLQKEQEKAFFAQLQLDEGTGEFLPIQ

SEQ ID NO: 1105 - protein, 40 aa, Artificial Sequence
  Description of Artificial Sequence: Synthetic polypeptide
EKQKKLEKERQEQLQKEQEKAFFAQLQLDEGTGEFLPIQP

SEQ ID NO: 1106 - protein, 40 aa, Artificial Sequence
  Description of Artificial Sequence: Synthetic polypeptide
KQKKLEKERQEQLQKEQEKAFFAQLQLDEGTGEFLPIQPA

SEQ ID NO: 1107 - protein, 40 aa, Artificial Sequence
  Description of Artificial Sequence: Synthetic polypeptide
KKLEKERQEQLQKEQEKAFFAQLQLDEGTGEFLPIQPAQH

SEQ ID NO: 1108 - protein, 40 aa, Artificial Sequence
  Description of Artificial Sequence: Synthetic polypeptide
QRRKEYELEKQKKLEKERQEQLQKEQEKAFFAQLQLDEQT

SEQ ID NO: 1109 - protein, 40 aa, Artificial Sequence
  Description of Artificial Sequence: Synthetic polypeptide
RRKEYELEKQKKLEKERQEQLQKEQEKAFFAQLQLDEQTG

SEQ ID NO: 1110 - protein, 40 aa, Artificial Sequence
  Description of Artificial Sequence: Synthetic polypeptide
RKEYELEKQKKLEKERQEQLQKEQEKAFFAQLQLDEQTGE

SEQ ID NO: 1111 - protein, 40 aa, Artificial Sequence
  Description of Artificial Sequence: Synthetic polypeptide
KEYELEKQKKLEKERQEQLQKEQEKAFFAQLQLDEQTGEF

SEQ ID NO: 1112 - protein, 40 aa, Artificial Sequence
  Description of Artificial Sequence: Synthetic polypeptide
EYELEKQKKLEKERQEQLQKEQEKAFFAQLQLDEQTGEFL

SEQ ID NO: 1113 - protein, 40 aa, Artificial Sequence
  Description of Artificial Sequence: Synthetic polypeptide
YELEKQKKLEKERQEQLQKEQEKAFFAQLQLDEQTGEFLP

SEQ ID NO: 1114 - protein, 40 aa, Artificial Sequence
  Description of Artificial Sequence: Synthetic polypeptide
ELEKQKKLEKERQEQLQKEQEKAFFAQLQLDEQTGEFLPI

SEQ ID NO: 1115 - protein, 40 aa, Artificial Sequence
  Description of Artificial Sequence: Synthetic polypeptide
LEKQKKLEKERQEQLQKEQEKAFFAQLQLDEQTGEFLPIQ

SEQ ID NO: 1116 - protein, 40 aa, Artificial Sequence
  Description of Artificial Sequence: Synthetic polypeptide
EKQKKLEKERQEQLQKEQEKAFFAQLQLDEQTGEFLPIQP

SEQ ID NO: 1117 - protein, 40 aa, Artificial Sequence
  Description of Artificial Sequence: Synthetic polypeptide
KQKKLEKERQEQLQKEQEKAFFAQLQLDEQTGEFLPIQPA

SEQ ID NO: 1118 - protein, 40 aa, Artificial Sequence
  Description of Artificial Sequence: Synthetic polypeptide
QKKLEKERQEQLQKEQEKAFFAQLQLDEQTGEFLPIQPAQ

SEQ ID NO: 1119 - protein, 40 aa, Artificial Sequence
  Description of Artificial Sequence: Synthetic polypeptide
QLQLDEQTGEFLPIQPAQHIQSETSGSANYSQVAHIPKSD

SEQ ID NO: 1120 - protein, 40 aa, Artificial Sequence
  Description of Artificial Sequence: Synthetic polypeptide
QRRKEYELEKQKKLEKERQEQLQKEQEKAFFAQLQLDEEA

SEQ ID NO: 1121 - protein, 40 aa, Artificial Sequence
  Description of Artificial Sequence: Synthetic polypeptide
RRKEYELEKQKKLEKERQEQLQKEQEKAFFAQLQLDEEAG

SEQ ID NO: 1122 - protein, 40 aa, Artificial Sequence
  Description of Artificial Sequence: Synthetic polypeptide
RKEYELEKQKKLEKERQEQLQKEQEKAFFAQLQLDEEAGE

SEQ ID NO: 1123 - protein, 40 aa, Artificial Sequence
  Description of Artificial Sequence: Synthetic polypeptide
KEYELEKQKKLEKERQEQLQKEQEKAFFAQLQLDEEAGEF

SEQ ID NO: 1124 - protein, 40 aa, Artificial Sequence
  Description of Artificial Sequence: Synthetic polypeptide
EYELEKQKKLEKERQEQLQKEQEKAFFAQLQLDEEAGEFL

SEQ ID NO: 1125 - protein, 40 aa, Artificial Sequence
  Description of Artificial Sequence: Synthetic polypeptide
YELEKQKKLEKERQEQLQKEQEKAFFAQLQLDEEAGEFLP

SEQ ID NO: 1126 - protein, 40 aa, Artificial Sequence
  Description of Artificial Sequence: Synthetic polypeptide
ELEKQKKLEKERQEQLQKEQEKAFFAQLQLDEEAGEFLPI

SEQ ID NO: 1127 - protein, 40 aa, Artificial Sequence
  Description of Artificial Sequence: Synthetic polypeptide
LEKQKKLEKERQEQLQKEQEKAFFAQLQLDEEAGEFLPIQ

SEQ ID NO: 1128 - protein, 40 aa, Artificial Sequence
  Description of Artificial Sequence: Synthetic polypeptide
EKQKKLEKERQEQLQKEQEKAFFAQLQLDEEAGEFLPIQP

SEQ ID NO: 1129 - protein, 40 aa, Artificial Sequence
  Description of Artificial Sequence: Synthetic polypeptide
KQKKLEKERQEQLQKEQEKAFFAQLQLDEEAGEFLPIQPA

SEQ ID NO: 1130 - protein, 40 aa, Artificial Sequence
  Description of Artificial Sequence: Synthetic polypeptide
QKKLEKERQEQLQKEQEKAFFAQLQLDEEAGEFLPIQPAQ

SEQ ID NO: 1131 - protein, 40 aa, Artificial Sequence
  Description of Artificial Sequence: Synthetic polypeptide
KKLEKERQEQLQKEQEKAFFAQLQLDEEAGEFLPIQPAQH

SEQ ID NO: 1132 - protein, 40 aa, Artificial Sequence
  Description of Artificial Sequence: Synthetic polypeptide
QRRKEYELEKQKKLEKERQEQLQKEQEKAFFAQLQLDEEI

SEQ ID NO: 1133 - protein, 40 aa, Artificial Sequence
  Description of Artificial Sequence: Synthetic polypeptide
RRKEYELEKQKKLEKERQEQLQKEQEKAFFAQLQLDEEIG

SEQ ID NO: 1134 - protein, 40 aa, Artificial Sequence
  Description of Artificial Sequence: Synthetic polypeptide
RKEYELEKQKKLEKERQEQLQKEQEKAFFAQLQLDEEIGE

SEQ ID NO: 1135 - protein, 40 aa, Artificial Sequence
  Description of Artificial Sequence: Synthetic polypeptide
KEYELEKQKKLEKERQEQLQKEQEKAFFAQLQLDEEIGEF

SEQ ID NO: 1136 - protein, 40 aa, Artificial Sequence
  Description of Artificial Sequence: Synthetic polypeptide
EYELEKQKKLEKERQEQLQKEQEKAFFAQLQLDEEIGEFL

SEQ ID NO: 1137 - protein, 40 aa, Artificial Sequence
  Description of Artificial Sequence: Synthetic polypeptide
YELEKQKKLEKERQEQLQKEQEKAFFAQLQLDEEIGEFLP

SEQ ID NO: 1138 - protein, 40 aa, Artificial Sequence
  Description of Artificial Sequence: Synthetic polypeptide
ELEKQKKLEKERQEQLQKEQEKAFFAQLQLDEEIGEFLPI

SEQ ID NO: 1139 - protein, 40 aa, Artificial Sequence
  Description of Artificial Sequence: Synthetic polypeptide
LEKQKKLEKERQEQLQKEQEKAFFAQLQLDEEIGEFLPIQ

SEQ ID NO: 1140 - protein, 40 aa, Artificial Sequence
  Description of Artificial Sequence: Synthetic polypeptide
EKQKKLEKERQEQLQKEQEKAFFAQLQLDEEIGEFLPIQP

SEQ ID NO: 1141 - protein, 40 aa, Artificial Sequence
  Description of Artificial Sequence: Synthetic polypeptide
KQKKLEKERQEQLQKEQEKAFFAQLQLDEEIGEFLPIQPA

SEQ ID NO: 1142 - protein, 40 aa, Artificial Sequence
  Description of Artificial Sequence: Synthetic polypeptide
KKLEKERQEQLQKEQEKAFFAQLQLDEEIGEFLPIQPAQH

SEQ ID NO: 1143 - protein, 40 aa, Artificial Sequence
  Description of Artificial Sequence: Synthetic polypeptide
RRKEYELEKQKKLEKERQEQLQKEQEKAFFAQLQLDEETS

SEQ ID NO: 1144 - protein, 40 aa, Artificial Sequence
  Description of Artificial Sequence: Synthetic polypeptide
RKEYELEKQKKLEKERQEQLQKEQEKAFFAQLQLDEETSE

SEQ ID NO: 1145 - protein, 40 aa, Artificial Sequence
  Description of Artificial Sequence: Synthetic polypeptide
KEYELEKQKKLEKERQEQLQKEQEKAFFAQLQLDEETSEF

SEQ ID NO: 1146 - protein, 40 aa, Artificial Sequence
  Description of Artificial Sequence: Synthetic polypeptide
EYELEKQKKLEKERQEQLQKEQEKAFFAQLQLDEETSEFL

SEQ ID NO: 1147 - protein, 40 aa, Artificial Sequence
  Description of Artificial Sequence: Synthetic polypeptide
YELEKQKKLEKERQEQLQKEQEKAFFAQLQLDEETSEFLP

SEQ ID NO: 1148 - protein, 40 aa, Artificial Sequence
  Description of Artificial Sequence: Synthetic polypeptide
ELEKQKKLEKERQEQLQKEQEKAFFAQLQLDEETSEFLPI

SEQ ID NO: 1149 - protein, 40 aa, Artificial Sequence
  Description of Artificial Sequence: Synthetic polypeptide
LEKQKKLEKERQEQLQKEQEKAFFAQLQLDEETSEFLPIQ

SEQ ID NO: 1150 - protein, 40 aa, Artificial Sequence
  Description of Artificial Sequence: Synthetic polypeptide
EKQKKLEKERQEQLQKEQEKAFFAQLQLDEETSEFLPIQP

SEQ ID NO: 1151 - protein, 40 aa, Artificial Sequence
  Description of Artificial Sequence: Synthetic polypeptide
KQKKLEKERQEQLQKEQEKAFFAQLQLDEETSEFLPIQPA

SEQ ID NO: 1152 - protein, 40 aa, Artificial Sequence
  Description of Artificial Sequence: Synthetic polypeptide
KKLEKERQEQLQKEQEKAFFAQLQLDEETSEFLPIQPAQH

SEQ ID NO: 1153 - protein, 40 aa, Artificial Sequence
  Description of Artificial Sequence: Synthetic polypeptide
RRKEYELEKQKKLEKERQEQLQKEQEKAFFAQLQLDEETV

SEQ ID NO: 1154 - protein, 40 aa, Artificial Sequence
  Description of Artificial Sequence: Synthetic polypeptide
RKEYELEKQKKLEKERQEQLQKEQEKAFFAQLQLDEETVE

SEQ ID NO: 1155 - protein, 40 aa, Artificial Sequence
  Description of Artificial Sequence: Synthetic polypeptide
KEYELEKQKKLEKERQEQLQKEQEKAFFAQLQLDEETVEF

SEQ ID NO: 1156 - protein, 40 aa, Artificial Sequence
  Description of Artificial Sequence: Synthetic polypeptide
EYELEKQKKLEKERQEQLQKEQEKAFFAQLQLDEETVEFL

SEQ ID NO: 1157 - protein, 40 aa, Artificial Sequence
  Description of Artificial Sequence: Synthetic polypeptide
YELEKQKKLEKERQEQLQKEQEKAFFAQLQLDEETVEFLP

SEQ ID NO: 1158 - protein, 40 aa, Artificial Sequence
  Description of Artificial Sequence: Synthetic polypeptide
ELEKQKKLEKERQEQLQKEQEKAFFAQLQLDEETVEFLPI

SEQ ID NO: 1159 - protein, 40 aa, Artificial Sequence
  Description of Artificial Sequence: Synthetic polypeptide
LEKQKKLEKERQEQLQKEQEKAFFAQLQLDEETVEFLPIQ

SEQ ID NO: 1160 - protein, 40 aa, Artificial Sequence
  Description of Artificial Sequence: Synthetic polypeptide
EKQKKLEKERQEQLQKEQEKAFFAQLQLDEETVEFLPIQP

SEQ ID NO: 1161 - protein, 40 aa, Artificial Sequence
  Description of Artificial Sequence: Synthetic polypeptide
KQKKLEKERQEQLQKEQEKAFFAQLQLDEETVEFLPIQPA

SEQ ID NO: 1162 - protein, 40 aa, Artificial Sequence
  Description of Artificial Sequence: Synthetic polypeptide
KKLEKERQEQLQKEQEKAFFAQLQLDEETVEFLPIQPAQH

SEQ ID NO: 1163 - protein, 40 aa, Artificial Sequence
  Description of Artificial Sequence: Synthetic polypeptide
EKERQEQLQKEQEKAFFAQLQLDEETVEFLPIQPAQHIQS

SEQ ID NO: 1164 - protein, 40 aa, Artificial Sequence
  Description of Artificial Sequence: Synthetic polypeptide
LDEETVEFLPIQPAQHIQSETSGSANYSQVAHIPKSDALY

SEQ ID NO: 1165 - protein, 40 aa, Artificial Sequence
  Description of Artificial Sequence: Synthetic polypeptide
RKEYELEKQKKLEKERQEQLQKEQEKAFFAQLQLDEETGD

SEQ ID NO: 1166 - protein, 40 aa, Artificial Sequence
  Description of Artificial Sequence: Synthetic polypeptide
KEYELEKQKKLEKERQEQLQKEQEKAFFAQLQLDEETGDF

SEQ ID NO: 1167 - protein, 40 aa, Artificial Sequence
  Description of Artificial Sequence: Synthetic polypeptide
EYELEKQKKLEKERQEQLQKEQEKAFFAQLQLDEETGDFL

SEQ ID NO: 1168 - protein, 40 aa, Artificial Sequence
  Description of Artificial Sequence: Synthetic polypeptide
YELEKQKKLEKERQEQLQKEQEKAFFAQLQLDEETGDFLP

SEQ ID NO: 1169 - protein, 40 aa, Artificial Sequence
  Description of Artificial Sequence: Synthetic polypeptide
ELEKQKKLEKERQEQLQKEQEKAFFAQLQLDEETGDFLPI

SEQ ID NO: 1170 - protein, 40 aa, Artificial Sequence
  Description of Artificial Sequence: Synthetic polypeptide
LEKQKKLEKERQEQLQKEQEKAFFAQLQLDEETGDFLPIQ

SEQ ID NO: 1171 - protein, 40 aa, Artificial Sequence
  Description of Artificial Sequence: Synthetic polypeptide
EKQKKLEKERQEQLQKEQEKAFFAQLQLDEETGDFLPIQP

SEQ ID NO: 1172 - protein, 40 aa, Artificial Sequence
  Description of Artificial Sequence: Synthetic polypeptide
KQKKLEKERQEQLQKEQEKAFFAQLQLDEETGDFLPIQPA

SEQ ID NO: 1173 - protein, 40 aa, Artificial Sequence
  Description of Artificial Sequence: Synthetic polypeptide
KKLEKERQEQLQKEQEKAFFAQLQLDEETGDFLPIQPAQH

SEQ ID NO: 1174 - protein, 40 aa, Artificial Sequence
  Description of Artificial Sequence: Synthetic polypeptide
ETGDFLPIQPAQHIQSETSGSANYSQVAHIPKSDALYFDD

SEQ ID NO: 1175 - protein, 40 aa, Artificial Sequence
  Description of Artificial Sequence: Synthetic polypeptide
RKEYELEKQKKLEKERQEQLQKEQEKAFFAQLQLDEETGV

SEQ ID NO: 1176 - protein, 40 aa, Artificial Sequence
  Description of Artificial Sequence: Synthetic polypeptide
KEYELEKQKKLEKERQEQLQKEQEKAFFAQLQLDEETGVF

SEQ ID NO: 1177 - protein, 40 aa, Artificial Sequence
  Description of Artificial Sequence: Synthetic polypeptide
EYELEKQKKLEKERQEQLQKEQEKAFFAQLQLDEETGVFL

SEQ ID NO: 1178 - protein, 40 aa, Artificial Sequence
  Description of Artificial Sequence: Synthetic polypeptide
YELEKQKKLEKERQEQLQKEQEKAFFAQLQLDEETGVFLP

SEQ ID NO: 1179 - protein, 40 aa, Artificial Sequence
  Description of Artificial Sequence: Synthetic polypeptide
ELEKQKKLEKERQEQLQKEQEKAFFAQLQLDEETGVFLPI

SEQ ID NO: 1180 - protein, 40 aa, Artificial Sequence
  Description of Artificial Sequence: Synthetic polypeptide
LEKQKKLEKERQEQLQKEQEKAFFAQLQLDEETGVFLPIQ

SEQ ID NO: 1181 - protein, 40 aa, Artificial Sequence
  Description of Artificial Sequence: Synthetic polypeptide
EKQKKLEKERQEQLQKEQEKAFFAQLQLDEETGVFLPIQP

SEQ ID NO: 1182 - protein, 40 aa, Artificial Sequence
  Description of Artificial Sequence: Synthetic polypeptide
KQKKLEKERQEQLQKEQEKAFFAQLQLDEETGVFLPIQPA

SEQ ID NO: 1183 - protein, 40 aa, Artificial Sequence
  Description of Artificial Sequence: Synthetic polypeptide
KKLEKERQEQLQKEQEKAFFAQLQLDEETGVFLPIQPAQH

SEQ ID NO: 1184 - protein, 40 aa, Artificial Sequence
  Description of Artificial Sequence: Synthetic polypeptide
LGSFECQRLQGYTGPRCEIDVNECVSNPCQNDATCLDQIG

SEQ ID NO: 1185 - protein, 40 aa, Artificial Sequence
  Description of Artificial Sequence: Synthetic polypeptide
CEHAGKCINTLGSFECQCLQGYTGPRYEIDVNECVSNPCQ

SEQ ID NO: 1186 - protein, 40 aa, Artificial Sequence
  Description of Artificial Sequence: Synthetic polypeptide
GSFECQCLQGYTGPRYEIDVNECVSNPCQNDATCLDQIGE

SEQ ID NO: 1187 - protein, 40 aa, Artificial Sequence
  Description of Artificial Sequence: Synthetic polypeptide
QGYTGPRYEIDVNECVSNPCQNDATCLDQIGEFQCICMPG

SEQ ID NO: 1188 - protein, 40 aa, Artificial Sequence
  Description of Artificial Sequence: Synthetic polypeptide
DVGKSALTIQLIQNHFVDEYDPTIEDSYRKQVVIDGETCL

SEQ ID NO: 1189 - protein, 40 aa, Artificial Sequence
  Description of Artificial Sequence: Synthetic polypeptide
YKLVVVGAGRVGKSALTIQLIQNHFVDEYDPTIEDSYRKQ

SEQ ID NO: 1190 - protein, 40 aa, Artificial Sequence; identical to SEQ ID NO: 883
  Description of Artificial Sequence: Synthetic polypeptide

SEQ ID NO: 1191 - protein, 40 aa, Artificial Sequence
  Description of Artificial Sequence: Synthetic polypeptide
VVVGAGGVGNSALTIQLIQNHFVDEYDPTIEDSYRKQVVI

SEQ ID NO: 1192 - protein, 40 aa, Artificial Sequence
  Description of Artificial Sequence: Synthetic polypeptide
VIDGETCLLDILDTAGKEEYSAMRDQYMRTGEGFLCVFAI

SEQ ID NO: 1193 - protein, 40 aa, Artificial Sequence
  Description of Artificial Sequence: Synthetic polypeptide
GKEEYSAMRDQYMRTGEGFLCVFAINNSKSFADINLYREQ

SEQ ID NO: 1194 - protein, 40 aa, Artificial Sequence
  Description of Artificial Sequence: Synthetic polypeptide
DEYDPTIEDSYRKQVVIDGETCLLDILDTAGREEYSAMRD

SEQ ID NO: 1195 - protein, 40 aa, Artificial Sequence
  Description of Artificial Sequence: Synthetic polypeptide
YRKQVVIDGETCLLDILDTAGREEYSAMRDQYMRTGEGFL

SEQ ID NO: 1196 - protein, 40 aa, Artificial Sequence
  Description of Artificial Sequence: Synthetic polypeptide
CLLDILDTAGREEYSAMRDQYMRTGEGFLCVFAINNSKSF

SEQ ID NO: 1197 - protein, 40 aa, Artificial Sequence
  Description of Artificial Sequence: Synthetic polypeptide
QNHFVDEYDPTIEDSYRKQVVIDGETCLLDILDTAGQKEY

SEQ ID NO: 1198 - protein, 40 aa, Artificial Sequence
  Description of Artificial Sequence: Synthetic polypeptide
ISTATPYMNGETSTKSLWVINSALRIKILCATYGNVNIRD

SEQ ID NO: 1199 - protein, 40 aa, Artificial Sequence
  Description of Artificial Sequence: Synthetic polypeptide
TATPYMNGETSTKSLWVINSALRIKILCATYGNVNIRDID

SEQ ID NO: 1200 - protein, 40 aa, Artificial Sequence
  Description of Artificial Sequence: Synthetic polypeptide
TPYMNGETSTKSLWVINSALRIKILCATYGNVNIRDIDKI

SEQ ID NO: 1201 - protein, 40 aa, Artificial Sequence
  Description of Artificial Sequence: Synthetic polypeptide
PYMNGETSTKSLWVINSALRIKILCATYGNVNIRDIDKIY

SEQ ID NO: 1202 - protein, 40 aa, Artificial Sequence
  Description of Artificial Sequence: Synthetic polypeptide
YMNGETSTKSLWVINSALRIKILCATYGNVNIRDIDKIYV

SEQ ID NO: 1203 - protein, 40 aa, Artificial Sequence
  Description of Artificial Sequence: Synthetic polypeptide
ETSTKSLWVINSALRIKILCATYGNVNIRDIDKIYVRTGI

SEQ ID NO: 1204 - protein, 40 aa, Artificial Sequence
  Description of Artificial Sequence: Synthetic polypeptide
VINSALRIKILCATYGNVNIRDIDKIYVRTGIYHGGEPLC

SEQ ID NO: 1205 - protein, 40 aa, Artificial Sequence
  Description of Artificial Sequence: Synthetic polypeptide
CATYGNVNIRDIDKIYVRTGIYHGGEPLCDNVNTQRVPCS

SEQ ID NO: 1206 - protein, 40 aa, Artificial Sequence
  Description of Artificial Sequence: Synthetic polypeptide
ISTATPYMNGETSTKSLWVINSALRIKILCATYMNVNIRD

SEQ ID NO: 1207 - protein, 40 aa, Artificial Sequence
  Description of Artificial Sequence: Synthetic polypeptide
STATPYMNGETSTKSLWVINSALRIKILCATYMNVNIRDI

SEQ ID NO: 1208 - protein, 40 aa, Artificial Sequence
  Description of Artificial Sequence: Synthetic polypeptide
TPYMNGETSTKSLWVINSALRIKILCATYMNVNIRDIDKI

SEQ ID NO: 1209 - protein, 40 aa, Artificial Sequence
  Description of Artificial Sequence: Synthetic polypeptide
PYMNGETSTKSLWVINSALRIKILCATYMNVNIRDIDKIY

SEQ ID NO: 1210 - protein, 40 aa, Artificial Sequence
  Description of Artificial Sequence: Synthetic polypeptide
YMNGETSTKSLWVINSALRIKILCATYMNVNIRDIDKIYV

SEQ ID NO: 1211 - protein, 40 aa, Artificial Sequence
  Description of Artificial Sequence: Synthetic polypeptide
MNGETSTKSLWVINSALRIKILCATYMNVNIRDIDKIYVR

SEQ ID NO: 1212 - protein, 40 aa, Artificial Sequence
  Description of Artificial Sequence: Synthetic polypeptide
GETSTKSLWVINSALRIKILCATYMNVNIRDIDKIYVRTG

SEQ ID NO: 1213 - protein, 40 aa, Artificial Sequence
  Description of Artificial Sequence: Synthetic polypeptide
ETSTKSLWVINSALRIKILCATYMNVNIRDIDKIYVRTGI

SEQ ID NO: 1214 - protein, 40 aa, Artificial Sequence
  Description of Artificial Sequence: Synthetic polypeptide
VINSALRIKILCATYMNVNIRDIDKIYVRTGIYHGGEPLC

SEQ ID NO: 1215 - protein, 40 aa, Artificial Sequence
  Description of Artificial Sequence: Synthetic polypeptide
LRIKILCATYMNVNIRDIDKIYVRTGIYHGGEPLCDNVNT

SEQ ID NO: 1216 - protein, 40 aa, Artificial Sequence
  Description of Artificial Sequence: Synthetic polypeptide
YMNVNIRDIDKIYVRTGIYHGGEPLCDNVNTQRVPCSNPR

SEQ ID NO: 1217 - protein, 40 aa, Artificial Sequence
  Description of Artificial Sequence: Synthetic polypeptide
ISTATPYMNGETSTKSLWVINSALRIKILCATYVIVNIRD

SEQ ID NO: 1218 - protein, 40 aa, Artificial Sequence
  Description of Artificial Sequence: Synthetic polypeptide
TATPYMNGETSTKSLWVINSALRIKILCATYVIVNIRDID

SEQ ID NO: 1219 - protein, 40 aa, Artificial Sequence
  Description of Artificial Sequence: Synthetic polypeptide
ATPYMNGETSTKSLWVINSALRIKILCATYVIVNIRDIDK

SEQ ID NO: 1220 - protein, 40 aa, Artificial Sequence
  Description of Artificial Sequence: Synthetic polypeptide
PYMNGETSTKSLWVINSALRIKILCATYVIVNIRDIDKIY

SEQ ID NO: 1221 - protein, 40 aa, Artificial Sequence
  Description of Artificial Sequence: Synthetic polypeptide
YMNGETSTKSLWVINSALRIKILCATYVIVNIRDIDKIYV

SEQ ID NO: 1222 - protein, 40 aa, Artificial Sequence
  Description of Artificial Sequence: Synthetic polypeptide
MNGETSTKSLWVINSALRIKILCATYVIVNIRDIDKIYVR

SEQ ID NO: 1223 - protein, 40 aa, Artificial Sequence
  Description of Artificial Sequence: Synthetic polypeptide
NGETSTKSLWVINSALRIKILCATYVIVNIRDIDKIYVRT

SEQ ID NO: 1224 - protein, 40 aa, Artificial Sequence
  Description of Artificial Sequence: Synthetic polypeptide
ETSTKSLWVINSALRIKILCATYVIVNIRDIDKIYVRTGI

SEQ ID NO: 1225 - protein, 40 aa, Artificial Sequence
  Description of Artificial Sequence: Synthetic polypeptide
SLWVINSALRIKILCATYVIVNIRDIDKIYVRTGIYHGGE

SEQ ID NO: 1226 - protein, 40 aa, Artificial Sequence
  Description of Artificial Sequence: Synthetic polypeptide
VINSALRIKILCATYVIVNIRDIDKIYVRTGIYHGGEPLC

SEQ ID NO: 1227 - protein, 40 aa, Artificial Sequence
  Description of Artificial Sequence: Synthetic polypeptide
ALRIKILCATYVIVNIRDIDKIYVRTGIYHGGEPLCDNVN

SEQ ID NO: 1228 - protein, 40 aa, Artificial Sequence
  Description of Artificial Sequence: Synthetic polypeptide
ATPYMNGETSTKSLWVINSALRIKILCATYVYVNIRDIDK

SEQ ID NO: 1229 - protein, 40 aa, Artificial Sequence
  Description of Artificial Sequence: Synthetic polypeptide
TPYMNGETSTKSLWVINSALRIKILCATYVYVNIRDIDKI

SEQ ID NO: 1230 - protein, 40 aa, Artificial Sequence
  Description of Artificial Sequence: Synthetic polypeptide
PYMNGETSTKSLWVINSALRIKILCATYVYVNIRDIDKIY

SEQ ID NO: 1231 - protein, 40 aa, Artificial Sequence
  Description of Artificial Sequence: Synthetic polypeptide
YMNGETSTKSLWVINSALRIKILCATYVYVNIRDIDKIYV

SEQ ID NO: 1232 - protein, 40 aa, Artificial Sequence
  Description of Artificial Sequence: Synthetic polypeptide
MNGETSTKSLWVINSALRIKILCATYVYVNIRDIDKIYVR

SEQ ID NO: 1233 - protein, 40 aa, Artificial Sequence
  Description of Artificial Sequence: Synthetic polypeptide
NGETSTKSLWVINSALRIKILCATYVYVNIRDIDKIYVRT

SEQ ID NO: 1234 - protein, 40 aa, Artificial Sequence
  Description of Artificial Sequence: Synthetic polypeptide
ETSTKSLWVINSALRIKILCATYVYVNIRDIDKIYVRTGI

SEQ ID NO: 1235 - protein, 40 aa, Artificial Sequence
  Description of Artificial Sequence: Synthetic polypeptide
VINSALRIKILCATYVYVNIRDIDKIYVRTGIYHGGEPLC

SEQ ID NO: 1236 - protein, 40 aa, Artificial Sequence
  Description of Artificial Sequence: Synthetic polypeptide
RIKILCATYVYVNIRDIDKIYVRTGIYHGGEPLCDNVNTQ

SEQ ID NO: 1237 - protein, 40 aa, Artificial Sequence
  Description of Artificial Sequence: Synthetic polypeptide
IKILCATYVYVNIRDIDKIYVRTGIYHGGEPLCDNVNTQR

SEQ ID NO: 1238 - protein, 40 aa, Artificial Sequence
  Description of Artificial Sequence: Synthetic polypeptide
TYVNVNIRDIDKIYVRTGIYHGGVPLCDNVNTQRVPCSNP

SEQ ID NO: 1239 - protein, 40 aa, Artificial Sequence
  Description of Artificial Sequence: Synthetic polypeptide
NVNIRDIDKIYVRTGIYHGGVPLCDNVNTQRVPCSNPRWN

SEQ ID NO: 1240 - protein, 40 aa, Artificial Sequence
  Description of Artificial Sequence: Synthetic polypeptide
RTGIYHGGVPLCDNVNTQRVPCSNPRWNEWLNYDIYIPDL

SEQ ID NO: 1241 - protein, 40 aa, Artificial Sequence
  Description of Artificial Sequence: Synthetic polypeptide
GGVPLCDNVNTQRVPCSNPRWNEWLNYDIYIPDLPRAARL

SEQ ID NO: 1242 - protein, 40 aa, Artificial Sequence
  Description of Artificial Sequence: Synthetic polypeptide
LNYDIYIPDLPRAARLCLSICSVKGRKGAKEEHRPLAWGN

SEQ ID NO: 1243 - protein, 40 aa, Artificial Sequence
  Description of Artificial Sequence: Synthetic polypeptide
ARLCLSICSVKGRKGAKEEHRPLAWGNINLFDYTDTLVSG

SEQ ID NO: 1244 - protein, 40 aa, Artificial Sequence
  Description of Artificial Sequence: Synthetic polypeptide
TLVSGKMALNLWPVPHGLEDLLNPIGVTGSNPNKETLCLE

SEQ ID NO: 1245 - protein, 40 aa, Artificial Sequence
  Description of Artificial Sequence: Synthetic polypeptide
SGKMALNLWPVPHGLEDLLNPIGVTGSNPNKETLCLELEF

SEQ ID NO: 1246 - protein, 40 aa, Artificial Sequence
  Description of Artificial Sequence: Synthetic polypeptide
GKMALNLWPVPHGLEDLLNPIGVTGSNPNKETLCLELEFD

SEQ ID NO: 1247 - protein, 40 aa, Artificial Sequence
  Description of Artificial Sequence: Synthetic polypeptide
KMALNLWPVPHGLEDLLNPIGVTGSNPNKETLCLELEFDW

SEQ ID NO: 1248 - protein, 40 aa, Artificial Sequence
  Description of Artificial Sequence: Synthetic polypeptide
ALNLWPVPHGLEDLLNPIGVTGSNPNKETLCLELEFDWFS

SEQ ID NO: 1249 - protein, 40 aa, Artificial Sequence
  Description of Artificial Sequence: Synthetic polypeptide
WPVPHGLEDLLNPIGVTGSNPNKETLCLELEFDWFSSVVK

SEQ ID NO: 1250 - protein, 40 aa, Artificial Sequence
  Description of Artificial Sequence: Synthetic polypeptide
PVPHGLEDLLNPIGVTGSNPNKETLCLELEFDWFSSVVKF

SEQ ID NO: 1251 - protein, 40 aa, Artificial Sequence
  Description of Artificial Sequence: Synthetic polypeptide
LLNPIGVTGSNPNKETLCLELEFDWFSSVVKFPDMSVIEE

SEQ ID NO: 1252 - protein, 40 aa, Artificial Sequence
  Description of Artificial Sequence: Synthetic polypeptide
SNPNKETLCLELEFDWFSSVVKFPDMSVIEEHANWSVSRE

SEQ ID NO: 1253 - protein, 40 aa, Artificial Sequence
  Description of Artificial Sequence: Synthetic polypeptide
NPNKETLCLELEFDWFSSVVKFPDMSVIEEHANWSVSREA

SEQ ID NO: 1254 - protein, 40 aa, Artificial Sequence
  Description of Artificial Sequence: Synthetic polypeptide
TLCLELEFDWFSSVVKFPDMSVIEEHANWSVSREAGFSYS

SEQ ID NO: 1255 - protein, 40 aa, Artificial Sequence
  Description of Artificial Sequence: Synthetic polypeptide
ELRENDKEQLKAISTRDRLSEITEQEKDFLWSHRHYCVTI

SEQ ID NO: 1256 - protein, 40 aa, Artificial Sequence
  Description of Artificial Sequence: Synthetic polypeptide
RDRLSEITEQEKDFLWSHRHYCVTIPEILPKLLLSVKWNS

SEQ ID NO: 1257 - protein, 40 aa, Artificial Sequence
  Description of Artificial Sequence: Synthetic polypeptide
DKEQLKAISTRDPLSEITAQEKDFLWSHRHYCVTIPEILP

SEQ ID NO: 1258 - protein, 40 aa, Artificial Sequence
  Description of Artificial Sequence: Synthetic polypeptide
AQEKDFLWSHRHYCVTIPEILPKLLLSVKWNSRDEVAQMY

SEQ ID NO: 1259 - protein, 40 aa, Artificial Sequence
  Description of Artificial Sequence: Synthetic polypeptide
EQLKAISTRDPLSEITKQEKDFLWSHRHYCVTIPEILPKL

SEQ ID NO: 1260 - protein, 40 aa, Artificial Sequence
  Description of Artificial Sequence: Synthetic polypeptide
SEITKQEKDFLWSHRHYCVTIPEILPKLLLSVKWNSRDEV

SEQ ID NO: 1261 - protein, 40 aa, Artificial Sequence
  Description of Artificial Sequence: Synthetic polypeptide
KAISTRDPLSEITEREKDFLWSHRHYCVTIPEILPKLLLS

SEQ ID NO: 1262 - protein, 40 aa, Artificial Sequence
  Description of Artificial Sequence: Synthetic polypeptide
RDPLSEITEREKDFLWSHRHYCVTIPEILPKLLLSVKWNS

SEQ ID NO: 1263 - protein, 40 aa, Artificial Sequence
  Description of Artificial Sequence: Synthetic polypeptide
NIMVKDDGQLFHIDFGHFLDHKKKKFGYKRERVPFVFTQD

SEQ ID NO: 1264 - protein, 40 aa, Artificial Sequence
  Description of Artificial Sequence: Synthetic polypeptide
MVKDDGQLFHIDFGHFLDHKKKKFGYKRERVPFVFTQDFL

SEQ ID NO: 1265 - protein, 40 aa, Artificial Sequence
  Description of Artificial Sequence: Synthetic polypeptide
VKDDGQLFHIDFGHFLDHKKKKFGYKRERVPFVFTQDFLI

SEQ ID NO: 1266 - protein, 40 aa, Artificial Sequence
  Description of Artificial Sequence: Synthetic polypeptide
KDDGQLFHIDFGHFLDHKKKKFGYKRERVPFVFTQDFLIV

SEQ ID NO: 1267 - protein, 40 aa, Artificial Sequence
  Description of Artificial Sequence: Synthetic polypeptide
DDGQLFHIDFGHFLDHKKKKFGYKRERVPFVFTQDFLIVI

SEQ ID NO: 1268 - protein, 40 aa, Artificial Sequence
  Description of Artificial Sequence: Synthetic polypeptide
DGQLFHIDFGHFLDHKKKKFGYKRERVPFVFTQDFLIVIS

SEQ ID NO: 1269 - protein, 40 aa, Artificial Sequence
  Description of Artificial Sequence: Synthetic polypeptide
GYKRERVPFVFTQDFLIVISKGAQECTKTREFERFQEMCY

SEQ ID NO: 1270 - protein, 40 aa, Artificial Sequence
  Description of Artificial Sequence: Synthetic polypeptide
YKRERVPFVFTQDFLIVISKGAQECTKTREFERFQEMCYK

SEQ ID NO: 1271 - protein, 40 aa, Artificial Sequence
  Description of Artificial Sequence: Synthetic polypeptide
KRERVPFVFTQDFLIVISKGAQECTKTREFERFQEMCYKA

SEQ ID NO: 1272 - protein, 40 aa, Artificial Sequence
  Description of Artificial Sequence: Synthetic polypeptide
RERVPFVFTQDFLIVISKGAQECTKTREFERFQEMCYKAY

SEQ ID NO: 1273 - protein, 40 aa, Artificial Sequence
  Description of Artificial Sequence: Synthetic polypeptide
VPFVFTQDFLIVISKGAQECTKTREFERFQEMCYKAYLAI

SEQ ID NO: 1274 - protein, 40 aa, Artificial Sequence
  Description of Artificial Sequence: Synthetic polypeptide
EEVNEKLRDTADGTFLVRDASTKMHGDYTLTLRKWGNNKL

SEQ ID NO: 1275 - protein, 40 aa, Artificial Sequence
  Description of Artificial Sequence: Synthetic polypeptide
DTADGTFLVRDASTKMHGDYTLTLRKWGNNKLIKIFHRDG

SEQ ID NO: 1276 - protein, 40 aa, Artificial Sequence
  Description of Artificial Sequence: Synthetic polypeptide
HGDYTLTLRKWGNNKLIKIFHRDGKYGFSDPLTFSSVVEL

SEQ ID NO: 1277 - protein, 40 aa, Artificial Sequence
  Description of Artificial Sequence: Synthetic polypeptide
GDYTLTLRKWGNNKLIKIFHRDGKYGFSDPLTFSSVVELI

SEQ ID NO: 1278 - protein, 40 aa, Artificial Sequence
  Description of Artificial Sequence: Synthetic polypeptide
DYTLTLRKWGNNKLIKIFHRDGKYGFSDPLTFSSVVELIN

SEQ ID NO: 1279 - protein, 40 aa, Artificial Sequence
  Description of Artificial Sequence: Synthetic polypeptide
KWGNNKLIKIFHRDGKYGFSDPLTFSSVVELINHYRNESL

SEQ ID NO: 1280 - protein, 40 aa, Artificial Sequence
  Description of Artificial Sequence: Synthetic polypeptide
REEVNEKLRDTADGTFLVRDASTKMHGDYTLTLRKGRNNK

SEQ ID NO: 1281 - protein, 40 aa, Artificial Sequence
  Description of Artificial Sequence: Synthetic polypeptide
REEVNEKLRDTADGTFLVRDASTKMHGDYTLTLRKGGNNE

SEQ ID NO: 1282 - protein, 40 aa, Artificial Sequence
  Description of Artificial Sequence: Synthetic polypeptide
EEVNEKLRDTADGTFLVRDASTKMHGDYTLTLRKGGNNEL

SEQ ID NO: 1283 - protein, 40 aa, Artificial Sequence
  Description of Artificial Sequence: Synthetic polypeptide
LVRDASTKMHGDYTLTLRKGGNNELIKIFHRDGKYGFSDP

SEQ ID NO: 1284 - protein, 40 aa, Artificial Sequence
  Description of Artificial Sequence: Synthetic polypeptide
RDASTKMHGDYTLTLRKGGNNELIKIFHRDGKYGFSDPLT

SEQ ID NO: 1285 - protein, 40 aa, Artificial Sequence
  Description of Artificial Sequence: Synthetic polypeptide
ASTKMHGDYTLTLRKGGNNELIKIFHRDGKYGFSDPLTFS

SEQ ID NO: 1286 - protein, 40 aa, Artificial Sequence
  Description of Artificial Sequence: Synthetic polypeptide
KMHGDYTLTLRKGGNNELIKIFHRDGKYGFSDPLTFSSVV

SEQ ID NO: 1287 - protein, 40 aa, Artificial Sequence
  Description of Artificial Sequence: Synthetic polypeptide
DYTLTLRKGGNNELIKIFHRDGKYGFSDPLTFSSVVELIN

SEQ ID NO: 1288 - protein, 40 aa, Artificial Sequence
  Description of Artificial Sequence: Synthetic polypeptide
EVNEKLRDTADGTFLVRDASTKMHGDYTLTLRKGGNNNLI

SEQ ID NO: 1289 - protein, 40 aa, Artificial Sequence
  Description of Artificial Sequence: Synthetic polypeptide
HGDYTLTLRKGGNNNLIKIFHRDGKYGFSDPLTFSSVVEL

SEQ ID NO: 1290 - protein, 40 aa, Artificial Sequence
  Description of Artificial Sequence: Synthetic polypeptide
GDYTLTLRKGGNNNLIKIFHRDGKYGFSDPLTFSSVVELI

SEQ ID NO: 1291 - protein, 40 aa, Artificial Sequence
  Description of Artificial Sequence: Synthetic polypeptide
TLTLRKGGNNNLIKIFHRDGKYGFSDPLTFSSVVELINHY

SEQ ID NO: 1292 - protein, 40 aa, Artificial Sequence
  Description of Artificial Sequence: Synthetic polypeptide
NNNLIKIFHRDGKYGFSDPLTFSSVVELINHYRNESLAQY

SEQ ID NO: 1293 - protein, 40 aa, Artificial Sequence
  Description of Artificial Sequence: Synthetic polypeptide
EKEIQRIMHNYDKLKSRISEIIDSRRRLEEDLKKQAAEYP

SEQ ID NO: 1294 - protein, 40 aa, Artificial Sequence
  Description of Artificial Sequence: Synthetic polypeptide
KEIQRIMHNYDKLKSRISEIIDSRRRLEEDLKKQAAEYPE

SEQ ID NO: 1295 - protein, 40 aa, Artificial Sequence
  Description of Artificial Sequence: Synthetic polypeptide
EIQRIMHNYDKLKSRISEIIDSRRRLEEDLKKQAAEYPEI

SEQ ID NO: 1296 - protein, 40 aa, Artificial Sequence
  Description of Artificial Sequence: Synthetic polypeptide
IQRIMHNYDKLKSRISEIIDSRRRLEEDLKKQAAEYPEID

SEQ ID NO: 1297 - protein, 40 aa, Artificial Sequence
  Description of Artificial Sequence: Synthetic polypeptide
IMHNYDKLKSRISEIIDSRRRLEEDLKKQAAEYPEIDKRM

SEQ ID NO: 1298 - protein, 40 aa, Artificial Sequence
  Description of Artificial Sequence: Synthetic polypeptide
HNYDKLKSRISEIIDSRRRLEEDLKKQAAEYPEIDKRMNS

SEQ ID NO: 1299 - protein, 40 aa, Artificial Sequence
  Description of Artificial Sequence: Synthetic polypeptide
SEIIDSRRRLEEDLKKQAAEYPEIDKRMNSIKPDLIQLRK

SEQ ID NO: 1300 - protein, 40 aa, Artificial Sequence
  Description of Artificial Sequence: Synthetic polypeptide
EIIDSRRRLEEDLKKQAAEYPEIDKRMNSIKPDLIQLRKT

SEQ ID NO: 1301 - protein, 40 aa, Artificial Sequence
  Description of Artificial Sequence: Synthetic polypeptide
IDSRRRLEEDLKKQAAEYPEIDKRMNSIKPDLIQLRKTRD

SEQ ID NO: 1302 - protein, 40 aa, Artificial Sequence
  Description of Artificial Sequence: Synthetic polypeptide
SRISEIIDSRRRLEEDLKKQAAEYREIGKRMNSIKPDLIQ

SEQ ID NO: 1303 - protein, 40 aa, Artificial Sequence
  Description of Artificial Sequence: Synthetic polypeptide
IQRIMHNYDKLKSRISEIIDSRRRLEEDLKKQAAEYREIY

SEQ ID NO: 1304 - protein, 40 aa, Artificial Sequence
  Description of Artificial Sequence: Synthetic polypeptide
DKLKSRISEIIDSRRRLEEDLKKQAAEYREIDKRMNSIEP

SEQ ID NO: 1305 - protein, 40 aa, Artificial Sequence
  Description of Artificial Sequence: Synthetic polypeptide
KLKSRISEIIDSRRRLEEDLKKQAAEYREIDKRMNSIEPD

SEQ ID NO: 1306 - protein, 40 aa, Artificial Sequence
  Description of Artificial Sequence: Synthetic polypeptide
KSRISEIIDSRRRLEEDLKKQAAEYREIDKRMNSIEPDLI

SEQ ID NO: 1307 - protein, 40 aa, Artificial Sequence
  Description of Artificial Sequence: Synthetic polypeptide
SEIIDSRRRLEEDLKKQAAEYREIDKRMNSIKTDLIQLRK

SEQ ID NO: 1308 - protein, 40 aa, Artificial Sequence
  Description of Artificial Sequence: Synthetic polypeptide
RLEEDLKKQAAEYREIDKRMNSIKTDLIQLRKTRDQYLMW

SEQ ID NO: 1309 - protein, 40 aa, Artificial Sequence
  Description of Artificial Sequence: Synthetic polypeptide
YFRNLCSDDTRMVRRAAASKLGEFAKVLELDNVKSEIIPM

SEQ ID NO: 1310 - protein, 40 aa, Artificial Sequence
  Description of Artificial Sequence: Synthetic polypeptide
CSDDTRMVRRAAASKLGEFAKVLELDNVKSEIIPMFSNLA

SEQ ID NO: 1311 - protein, 40 aa, Artificial Sequence
  Description of Artificial Sequence: Synthetic polypeptide
RMVRRAAASKLGEFAKVLELDNVKSEIIPMFSNLASDEQD

SEQ ID NO: 1312 - protein, 40 aa, Artificial Sequence
  Description of Artificial Sequence: Synthetic polypeptide
TPMVWRAAASKLGEFAKVLELDNVKSEIIPMFSNLASDEQ

SEQ ID NO: 1313 - protein, 40 aa, Artificial Sequence
  Description of Artificial Sequence: Synthetic polypeptide
QYFRNLCSDDTPMVRWAAASKLGEFAKVLELDNVKSEIIP

SEQ ID NO: 1314 - protein, 40 aa, Artificial Sequence
  Description of Artificial Sequence: Synthetic polypeptide
RNLCSDDTPMVRWAAASKLGEFAKVLELDNVKSEIIPMFS

SEQ ID NO: 1315 - protein, 40 aa, Artificial Sequence
  Description of Artificial Sequence: Synthetic polypeptide
WAAASKLGEFAKVLELDNVKSEIIPMFSNLASDEQDSVRL

SEQ ID NO: 1316 - protein, 40 aa, Artificial Sequence
  Description of Artificial Sequence: Synthetic polypeptide
MFSNLASDEKDSVRLLAVEACVNIAQLLPQEDLEALVMPT

SEQ ID NO: 1317 - protein, 40 aa, Artificial Sequence
  Description of Artificial Sequence: Synthetic polypeptide
VRRAAASKLGEFAKVLELDNVKSEIIPMFSNLASDERDSV

SEQ ID NO: 1318 - protein, 40 aa, Artificial Sequence
  Description of Artificial Sequence: Synthetic polypeptide
RRAAASKLGEFAKVLELDNVKSEIIPMFSNLASDEQDSMR

SEQ ID NO: 1319 - protein, 40 aa, Artificial Sequence
  Description of Artificial Sequence: Synthetic polypeptide
NVKSEIIPMFSNLASDEQDSMRLLAVEACVNIAQLLPQED

SEQ ID NO: 1320 - protein, 40 aa, Artificial Sequence
  Description of Artificial Sequence: Synthetic polypeptide
PQEDLEALVMPTLRQAAEDKYWRVRYMVADKFTELQKAVG

SEQ ID NO: 1321 - protein, 40 aa, Artificial Sequence
  Description of Artificial Sequence: Synthetic polypeptide
VMPTLRQAAEDKYWRVRYMVADKFTELQKAVGPEITKTDL

SEQ ID NO: 1322 - protein, 40 aa, Artificial Sequence
  Description of Artificial Sequence: Synthetic polypeptide
QLLPQEDLEALVMPTLRQAAEDKSCRVRYMVADKFTELQK

SEQ ID NO: 1323 - protein, 40 aa, Artificial Sequence
  Description of Artificial Sequence: Synthetic polypeptide
EDLEALVMPTLRQAAEDKSCRVRYMVADKFTELQKAVGPE

SEQ ID NO: 1324 - protein, 40 aa, Artificial Sequence
  Description of Artificial Sequence: Synthetic polypeptide
AVEACVNIAQLLPQEDLEALVMPTLRQAAEDKSWCVRYMV

SEQ ID NO: 1325 - protein, 40 aa, Artificial Sequence
  Description of Artificial Sequence: Synthetic polypeptide
QLLPQEDLEALVMPTLRQAAEDKSWCVRYMVADKFTELQK

SEQ ID NO: 1326 - protein, 40 aa, Artificial Sequence
  Description of Artificial Sequence: Synthetic polypeptide
AVEACVNIAQLLPQEDLEALVMPTLRQAAEDKSWHVRYMV

SEQ ID NO: 1327 - protein, 40 aa, Artificial Sequence
  Description of Artificial Sequence: Synthetic polypeptide
LVMPTLRQAAEDKSWHVRYMVADKFTELQKAVGPEITKTD

SEQ ID NO: 1328 - protein, 40 aa, Artificial Sequence
  Description of Artificial Sequence: Synthetic polypeptide
VMPTLRQAAEDKSWHVRYMVADKFTELQKAVGPEITKTDL

SEQ ID NO: 1329 - protein, 40 aa, Artificial Sequence
  Description of Artificial Sequence: Synthetic polypeptide
SWRVGYMVADKFTELQKAVGPEITKTDLVPAFQNLMKDCE

SEQ ID NO: 1330 - protein, 40 aa, Artificial Sequence
  Description of Artificial Sequence: Synthetic polypeptide
TDKVKQGFWEEFETLQQQECKLLYSRKEGQRQENKNKNRC

SEQ ID NO: 1331 - protein, 40 aa, Artificial Sequence
  Description of Artificial Sequence: Synthetic polypeptide
VKQGFWEEFETLQQQECKLLYSRKEGQRQENKNKNRCKNI

SEQ ID NO: 1332 - protein, 40 aa, Artificial Sequence
  Description of Artificial Sequence: Synthetic polypeptide
GFWEEFETLQQQECKLLYSRKEGQRQENKNKNRCKNILPF

SEQ ID NO: 1333 - protein, 40 aa, Artificial Sequence
  Description of Artificial Sequence: Synthetic polypeptide
FWEEFETLQQQECKLLYSRKEGQRQENKNKNRCKNILPFD

SEQ ID NO: 1334 - protein, 40 aa, Artificial Sequence
  Description of Artificial Sequence: Synthetic polypeptide
WEEFETLQQQECKLLYSRKEGQRQENKNKNRCKNILPFDH

SEQ ID NO: 1335 - protein, 40 aa, Artificial Sequence
  Description of Artificial Sequence: Synthetic polypeptide
EFETLQQQECKLLYSRKEGQRQENKNKNRCKNILPFDHTR

SEQ ID NO: 1336 - protein, 40 aa, Artificial Sequence
  Description of Artificial Sequence: Synthetic polypeptide
QENKNKNRCKNILPFDHTRVVLHDGDPNEPVSDYINANII

SEQ ID NO: 1337 - protein, 40 aa, Artificial Sequence
  Description of Artificial Sequence: Synthetic polypeptide
QGFWEEFETLQQQECKLLYSRKEGQRQENKNKNRYKNMLP

SEQ ID NO: 1338 - protein, 40 aa, Artificial Sequence
  Description of Artificial Sequence: Synthetic polypeptide
GFWEEFETLQQQECKLLYSRKEGQRQENKNKNRYKNMLPF

SEQ ID NO: 1339 - protein, 40 aa, Artificial Sequence
  Description of Artificial Sequence: Synthetic polypeptide
FWEEFETLQQQECKLLYSRKEGQRQENKNKNRYKNMLPFD

SEQ ID NO: 1340 - protein, 40 aa, Artificial Sequence
  Description of Artificial Sequence: Synthetic polypeptide
LLYSRKEGQRQENKNKNRYKNMLPFDHTRVVLHDGDPNEP

SEQ ID NO: 1341 - protein, 40 aa, Artificial Sequence
  Description of Artificial Sequence: Synthetic polypeptide
LYSRKEGQRQENKNKNRYKNMLPFDHTRVVLHDGDPNEPV

SEQ ID NO: 1342 - protein, 40 aa, Artificial Sequence
  Description of Artificial Sequence: Synthetic polypeptide
YSRKEGQRQENKNKNRYKNMLPFDHTRVVLHDGDPNEPVS

SEQ ID NO: 1343 - protein, 40 aa, Artificial Sequence
  Description of Artificial Sequence: Synthetic polypeptide
SRKEGQRQENKNKNRYKNMLPFDHTRVVLHDGDPNEPVSD

SEQ ID NO: 1344 - protein, 40 aa, Artificial Sequence
  Description of Artificial Sequence: Synthetic polypeptide
RKEGQRQENKNKNRYKNMLPFDHTRVVLHDGDPNEPVSDY

SEQ ID NO: 1345 - protein, 40 aa, Artificial Sequence
  Description of Artificial Sequence: Synthetic polypeptide
KEGQRQENKNKNRYKNMLPFDHTRVVLHDGDPNEPVSDYI

SEQ ID NO: 1346 - protein, 40 aa, Artificial Sequence
  Description of Artificial Sequence: Synthetic polypeptide
EGQRQENKNKNRYKNMLPFDHTRVVLHDGDPNEPVSDYIN

SEQ ID NO: 1347 - protein, 40 aa, Artificial Sequence
  Description of Artificial Sequence: Synthetic polypeptide
GQRQENKNKNRYKNMLPFDHTRVVLHDGDPNEPVSDYINA

SEQ ID NO: 1348 - protein, 40 aa, Artificial Sequence
  Description of Artificial Sequence: Synthetic polypeptide
ENKNKNRYKNMLPFDHTRVVLHDGDPNEPVSDYINANIIM

SEQ ID NO: 1349 - protein, 40 aa, Artificial Sequence
  Description of Artificial Sequence: Synthetic polypeptide
NKNKNRYKNMLPFDHTRVVLHDGDPNEPVSDYINANIIMP

SEQ ID NO: 1350 - protein, 40 aa, Artificial Sequence
  Description of Artificial Sequence: Synthetic polypeptide
DHGVPSDPGGVLDFLEEVHHKQESIMDAGPVVVHCSGGIG

SEQ ID NO: 1351 - protein, 40 aa, Artificial Sequence
  Description of Artificial Sequence: Synthetic polypeptide
VLDFLEEVHHKQESIMDAGPVVVHCSGGIGRTGTFIVIDI

SEQ ID NO: 1352 - protein, 40 aa, Artificial Sequence
  Description of Artificial Sequence: Synthetic polypeptide
VVVHCSTGIGRTGTFIVIDILIDIIREKGVDCDIDVPKTI

SEQ ID NO: 1353 - protein, 40 aa, Artificial Sequence
  Description of Artificial Sequence: Synthetic polypeptide
CSAGIGRTGTFIVIDILIDIIREKGVDCDIDVPKTIQMVW

SEQ ID NO: 1354 - protein, 40 aa, Artificial Sequence
  Description of Artificial Sequence: Synthetic polypeptide
SAGIGRTGTFIVIDILIDIIREKGVDCDIDVPKTIQMVWS

SEQ ID NO: 1355 - protein, 40 aa, Artificial Sequence
  Description of Artificial Sequence: Synthetic polypeptide
IGRTGTFIVIDILIDIIREKGVDCDIDVPKTIQMVWSQRS

SEQ ID NO: 1356 - protein, 40 aa, Artificial Sequence
  Description of Artificial Sequence: Synthetic polypeptide
DVPKTIQMVWSQRSGMVQTEAQYRFIYMAVQHYIETLQRR

SEQ ID NO: 1357 - protein, 40 aa, Artificial Sequence
  Description of Artificial Sequence: Synthetic polypeptide
KTIQMVWSQRSGMVQTEAQYRFIYMAVQHYIETLQRRIEE

SEQ ID NO: 1358 - protein, 40 aa, Artificial Sequence
  Description of Artificial Sequence: Synthetic polypeptide
TIQMVWSQRSGMVQTEAQYRFIYMAVQHYIETLQRRIEEE

SEQ ID NO: 1359 - protein, 40 aa, Artificial Sequence
  Description of Artificial Sequence: Synthetic polypeptide
WSQRSGMVQTEAQYRFIYMAVQHYIETLQRRIEEEQKSKR

SEQ ID NO: 1360 - protein, 40 aa, Artificial Sequence
  Description of Artificial Sequence: Synthetic polypeptide
IDILIDIIREKGVDCDIDVPKTIQMVRSQRSVMVQTEAQY

SEQ ID NO: 1361 - protein, 40 aa, Artificial Sequence
  Description of Artificial Sequence: Synthetic polypeptide
DILIDIIREKGVDCDIDVPKTIQMVRSQRSVMVQTEAQYR

SEQ ID NO: 1362 - protein, 40 aa, Artificial Sequence
  Description of Artificial Sequence: Synthetic polypeptide
DIIREKGVDCDIDVPKTIQMVRSQRSVMVQTEAQYRFIYM

SEQ ID NO: 1363 - protein, 40 aa, Artificial Sequence
  Description of Artificial Sequence: Synthetic polypeptide
REKGVDCDIDVPKTIQMVRSQRSVMVQTEAQYRFIYMAVQ

SEQ ID NO: 1364 - protein, 40 aa, Artificial Sequence
  Description of Artificial Sequence: Synthetic polypeptide
VDCDIDVPKTIQMVRSQRSVMVQTEAQYRFIYMAVQHYIE

SEQ ID NO: 1365 - protein, 40 aa, Artificial Sequence
  Description of Artificial Sequence: Synthetic polypeptide
QMVRSQRSVMVQTEAQYRFIYMAVQHYIETLQRRIEEEQK

SEQ ID NO: 1366 - protein, 40 aa, Artificial Sequence
  Description of Artificial Sequence: Synthetic polypeptide
SVMVQTEAQYRFIYMAVQHYIETLQRRIEEEQKSKRKGHE

SEQ ID NO: 1367 - protein, 40 aa, Artificial Sequence
  Description of Artificial Sequence: Synthetic polypeptide
IDILIDIIREKGVDCDIDVPKTIQMVRSQRSGIVQTEAQY

SEQ ID NO: 1368 - protein, 40 aa, Artificial Sequence
  Description of Artificial Sequence: Synthetic polypeptide
DIIREKGVDCDIDVPKTIQMVRSQRSGIVQTEAQYRFIYM

SEQ ID NO: 1369 - protein, 40 aa, Artificial Sequence
  Description of Artificial Sequence: Synthetic polypeptide
DIDVPKTIQMVRSQRSGIVQTEAQYRFIYMAVQHYIETLQ

SEQ ID NO: 1370 - protein, 40 aa, Artificial Sequence
  Description of Artificial Sequence: Synthetic polypeptide
DIIREKGVDCDIDVPKTIQMVRSQRSGMVQKEAQYRFIYM

SEQ ID NO: 1371 - protein, 40 aa, Artificial Sequence
  Description of Artificial Sequence: Synthetic polypeptide
KGVDCDIDVPKTIQMVRSQRSGMVQKEAQYRFIYMAVQHY

SEQ ID NO: 1372 - protein, 40 aa, Artificial Sequence
  Description of Artificial Sequence: Synthetic polypeptide
MVQKEAQYRFIYMAVQHYIETLQRRIEEEQKSKRKGHEYT

SEQ ID NO: 1373 - protein, 40 aa, Artificial Sequence
  Description of Artificial Sequence: Synthetic polypeptide
ILIDIIREKGVDCDIDVPKTIQMVRSQRSGMVQTEALYRF

SEQ ID NO: 1374 - protein, 40 aa, Artificial Sequence
  Description of Artificial Sequence: Synthetic polypeptide
VDCDIDVPKTIQMVRSQRSGMVQTEALYRFIYMAVQHYIE

SEQ ID NO: 1375 - protein, 40 aa, Artificial Sequence
  Description of Artificial Sequence: Synthetic polypeptide
VRSQRSGMVQTEALYRFIYMAVQHYIETLQRRIEEEQKSK

SEQ ID NO: 1376 - protein, 40 aa, Artificial Sequence
  Description of Artificial Sequence: Synthetic polypeptide
KSNPGDFTLSVRRNGAVTHIKIQNTVDYYDLYGGEKFATL

SEQ ID NO: 1377 - protein, 40 aa, Artificial Sequence
  Description of Artificial Sequence: Synthetic polypeptide
FTLSVRRNGAVTHIKIQNTVDYYDLYGGEKFATLAELVQY

SEQ ID NO: 1378 - protein, 40 aa, Artificial Sequence
  Description of Artificial Sequence: Synthetic polypeptide
LSVRRNGAVTHIKIQNTGDYYDLYGGEKLATLAELVQYYM

SEQ ID NO: 1379 - protein, 40 aa, Artificial Sequence
  Description of Artificial Sequence: Synthetic polypeptide
THIKIQNTGDYYDLYGGEKLATLAELVQYYMEHHGQLKEK

SEQ ID NO: 1380 - protein, 40 aa, Artificial Sequence
  Description of Artificial Sequence: Synthetic polypeptide
IQNTGDYYDLYGGEKFDTLAELVQYYMEHHGQLKEKNGDV

SEQ ID NO: 1381 - protein, 40 aa, Artificial Sequence
  Description of Artificial Sequence: Synthetic polypeptide
TGDYYDLYGGEKFDTLAELVQYYMEHHGQLKEKNGDVIEL

SEQ ID NO: 1382 - protein, 40 aa, Artificial Sequence
  Description of Artificial Sequence: Synthetic polypeptide
ATLAALVQYYMEHHGQLKEKNGDVIELKYPLNCADPTSER

SEQ ID NO: 1383 - protein, 40 aa, Artificial Sequence
  Description of Artificial Sequence: Synthetic polypeptide
SVRRNGAVTHIKIQNTGDYYDLYGGEKFATLAKLVQYYME

SEQ ID NO: 1384 - protein, 40 aa, Artificial Sequence
  Description of Artificial Sequence: Synthetic polypeptide
GAVTHIKIQNTGDYYDLYGGEKFATLAKLVQYYMEHHGQL

SEQ ID NO: 1385 - protein, 40 aa, Artificial Sequence
  Description of Artificial Sequence: Synthetic polypeptide
NTGDYYDLYGGEKFATLAKLVQYYMEHHGQLKEKNGDVIE

SEQ ID NO: 1386 - protein, 40 aa, Artificial Sequence
  Description of Artificial Sequence: Synthetic polypeptide
KWYPEVRHHCPNTPIILVGTNLDLRDDKDTIEKLKEKKLT

SEQ ID NO: 1387 - protein, 40 aa, Artificial Sequence
  Description of Artificial Sequence: Synthetic polypeptide
PEVRHHCPNTPIILVGTNLDLRDDKDTIEKLKEKKLTPIT

SEQ ID NO: 1388 - protein, 40 aa, Artificial Sequence
  Description of Artificial Sequence: Synthetic polypeptide
AIKCVVVGDGAVSKTCLLISYTTNAFPGEYIPTVFDNYSA

SEQ ID NO: 1389 - protein, 40 aa, Artificial Sequence
  Description of Artificial Sequence: Synthetic polypeptide
KLTPITYPQGLAMAKEIGAVKYLECSVLTQRGLKTVFDEA

SEQ ID NO: 1390 - protein, 40 aa, Artificial Sequence
  Description of Artificial Sequence: Synthetic polypeptide
CVVVGDGAVGKTCLLISYTTNAFLGEYIPTVFDNYSANVM

SEQ ID NO: 1391 - protein, 40 aa, Artificial Sequence
  Description of Artificial Sequence: Synthetic polypeptide
VVGDGAVGKTCLLISYTTNAFLGEYIPTVFDNYSANVMVD

SEQ ID NO: 1392 - protein, 40 aa, Artificial Sequence
  Description of Artificial Sequence: Synthetic polypeptide
VVVGDGAVGKTCLLISYTTNAFSGEYIPTVFDNYSANVMV

SEQ ID NO: 1393 - protein, 40 aa, Artificial Sequence
  Description of Artificial Sequence: Synthetic polypeptide
AFPGEYIPTVFDNYSANVMVDGKPVNLGLWDTAGREDYDR

SEQ ID NO: 1394 - protein, 40 aa, Artificial Sequence
  Description of Artificial Sequence: Synthetic polypeptide
SANVMVDGKPVNLGLWDTAGREDYDRLRPLSYPQTVGETY

SEQ ID NO: 1395 - protein, 40 aa, Artificial Sequence
  Description of Artificial Sequence: Synthetic polypeptide
VMVDGKPVNLGLWDTAGREDYDRLRPLSYPQTVGETYGKD

SEQ ID NO: 1396 - protein, 40 aa, Artificial Sequence
  Description of Artificial Sequence: Synthetic polypeptide
MVDGKPVNLGLWDTAGREDYDRLRPLSYPQTVGETYGKDI

SEQ ID NO: 1397 - protein, 40 aa, Artificial Sequence
  Description of Artificial Sequence: Synthetic polypeptide
DGKPVNLGLWDTAGREDYDRLRPLSYPQTVGETYGKDITS

SEQ ID NO: 1398 - protein, 40 aa, Artificial Sequence
  Description of Artificial Sequence: Synthetic polypeptide
PVNLGLWDTAGREDYDRLRPLSYPQTVGETYGKDITSRGK

SEQ ID NO: 1399 - protein, 40 aa, Artificial Sequence
  Description of Artificial Sequence: Synthetic polypeptide
DTAGREDYDRLRPLSYPQTVGETYGKDITSRGKDKPIADV

SEQ ID NO: 1400 - protein, 40 aa, Artificial Sequence
  Description of Artificial Sequence: Synthetic polypeptide
REDYDRLRPLSYPQTVGETYGKDITSRGKDKPIADVFLIC

SEQ ID NO: 1401 - protein, 40 aa, Artificial Sequence
  Description of Artificial Sequence: Synthetic polypeptide
VFDNYSANVMVDGKPVNLGLWDTAGQEDYDRLHPLSYPQT

SEQ ID NO: 1402 - protein, 40 aa, Artificial Sequence
  Description of Artificial Sequence: Synthetic polypeptide
VMVDGKPVNLGLWDTAGQEDYDRLHPLSYPQTVGETYGKD

SEQ ID NO: 1403 - protein, 40 aa, Artificial Sequence
  Description of Artificial Sequence: Synthetic polypeptide
MVDGKPVNLGLWDTAGQEDYDRLHPLSYPQTVGETYGKDI

SEQ ID NO: 1404 - protein, 40 aa, Artificial Sequence
  Description of Artificial Sequence: Synthetic polypeptide
VDGKPVNLGLWDTAGQEDYDRLHPLSYPQTVGETYGKDIT

SEQ ID NO: 1405 - protein, 40 aa, Artificial Sequence
  Description of Artificial Sequence: Synthetic polypeptide
VNLGLWDTAGQEDYDRLHPLSYPQTVGETYGKDITSRGKD

SEQ ID NO: 1406 - protein, 40 aa, Artificial Sequence
  Description of Artificial Sequence: Synthetic polypeptide
LGLWDTAGQEDYDRLHPLSYPQTVGETYGKDITSRGKDKP

SEQ ID NO: 1407 - protein, 40 aa, Artificial Sequence
  Description of Artificial Sequence: Synthetic polypeptide
LWDTAGQEDYDRLHPLSYPQTVGETYGKDITSRGKDKPIA

SEQ ID NO: 1408 - protein, 40 aa, Artificial Sequence
  Description of Artificial Sequence: Synthetic polypeptide
WDTAGQEDYDRLHPLSYPQTVGETYGKDITSRGKDKPIAD

SEQ ID NO: 1409 - protein, 40 aa, Artificial Sequence
  Description of Artificial Sequence: Synthetic polypeptide
TAGQEDYDRLHPLSYPQTVGETYGKDITSRGKDKPIADVF

SEQ ID NO: 1410 - protein, 40 aa, Artificial Sequence
  Description of Artificial Sequence: Synthetic polypeptide
QEDYDRLHPLSYPQTVGETYGKDITSRGKDKPIADVFLIC

SEQ ID NO: 1411 - protein, 40 aa, Artificial Sequence
  Description of Artificial Sequence: Synthetic polypeptide
YDRLHPLSYPQTVGETYGKDITSRGKDKPIADVFLICFSL

SEQ ID NO: 1412 - protein, 40 aa, Artificial Sequence
  Description of Artificial Sequence: Synthetic polypeptide
LHPLSYPQTVGETYGKDITSRGKDKPIADVFLICFSLVSP

SEQ ID NO: 1413 - protein, 40 aa, Artificial Sequence
  Description of Artificial Sequence: Synthetic polypeptide
LASILLRIFLHEKLESLLLCTLNDREISMEDEATTLFLAT

SEQ ID NO: 1414 - protein, 40 aa, Artificial Sequence
  Description of Artificial Sequence: Synthetic polypeptide
LLLCTLNDREISMEDEATTLFLATTLASTLMEQYMKATAT

SEQ ID NO: 1415 - protein, 40 aa, Artificial Sequence
  Description of Artificial Sequence: Synthetic polypeptide
CTLNDREISMEDEATTLFLATTLASTLMEQYMKATATQFV

SEQ ID NO: 1416 - protein, 40 aa, Artificial Sequence
  Description of Artificial Sequence: Synthetic polypeptide
EDEATTLFLATTLASTLMEQYMKATATQFVHHALKDSILK

SEQ ID NO: 1417 - protein, 40 aa, Artificial Sequence
  Description of Artificial Sequence: Synthetic polypeptide
TLFLATTLASTLMEQYMKATATQFVHHALKDSILKIMESK

SEQ ID NO: 1418 - protein, 40 aa, Artificial Sequence
  Description of Artificial Sequence: Synthetic polypeptide
KAFDFYKVIESFIKAEGNLTREMIKHLERCEHRIMESLAS

SEQ ID NO: 1419 - protein, 40 aa, Artificial Sequence
  Description of Artificial Sequence: Synthetic polypeptide
SFIKAEGNLTREMIKHLERCEHRIMESLASLSDSPLFDLI

SEQ ID NO: 1420 - protein, 40 aa, Artificial Sequence
  Description of Artificial Sequence: Synthetic polypeptide
FIKAEGNLTREMIKHLERCEHRIMESLASLSDSPLFDLIK

SEQ ID NO: 1421 - protein, 40 aa, Artificial Sequence
  Description of Artificial Sequence: Synthetic polypeptide
IKAEGNLTREMIKHLERCEHRIMESLASLSDSPLFDLIKQ

SEQ ID NO: 1422 - protein, 40 aa, Artificial Sequence
  Description of Artificial Sequence: Synthetic polypeptide
MIKHLERCEHRIMESLASLSDSPLFDLIKQSKDREGPTDH

SEQ ID NO: 1423 - protein, 40 aa, Artificial Sequence
  Description of Artificial Sequence: Synthetic polypeptide
HLERCEHRIMESLASLSDSPLFDLIKQSKDREGPTDHLES

SEQ ID NO: 1424 - protein, 40 aa, Artificial Sequence
  Description of Artificial Sequence: Synthetic polypeptide
CEHRIMESLASLSDSPLFDLIKQSKDREGPTDHLESACPL

SEQ ID NO: 1425 - protein, 40 aa, Artificial Sequence
  Description of Artificial Sequence: Synthetic polypeptide
SLTIQFVEGQFVDSYDPTIENTFTKLITVNGQEYHLQLVV

SEQ ID NO: 1426 - protein, 40 aa, Artificial Sequence
  Description of Artificial Sequence: Synthetic polypeptide
KLITVNGQEYHLQLVVTAGQDEYSIFPQTYSIDINGYILV

SEQ ID NO: 1427 - protein, 40 aa, Artificial Sequence
  Description of Artificial Sequence: Synthetic polypeptide
VNGQEYHLQLVVTAGQDEYSIFPQTYSIDINGYILVYSVT

SEQ ID NO: 1428 - protein, 40 aa, Artificial Sequence
  Description of Artificial Sequence: Synthetic polypeptide
QEYHLQLVVTAGQDEYSIFPQTYSIDINGYILVYSVTSIK

SEQ ID NO: 1429 - protein, 40 aa, Artificial Sequence
  Description of Artificial Sequence: Synthetic polypeptide
QLVVTAGQDEYSIFPQTYSIDINGYILVYSVTSIKSFEVI

SEQ ID NO: 1430 - protein, 40 aa, Artificial Sequence
  Description of Artificial Sequence: Synthetic polypeptide
LVVTAGQDEYSIFPQTYSIDINGYILVYSVTSIKSFEVIK

SEQ ID NO: 1431 - protein, 40 aa, Artificial Sequence
  Description of Artificial Sequence: Synthetic polypeptide
VVTAGQDEYSIFPQTYSIDINGYILVYSVTSIKSFEVIKV

SEQ ID NO: 1432 - protein, 40 aa, Artificial Sequence
  Description of Artificial Sequence: Synthetic polypeptide
VTAGQDEYSIFPQTYSIDINGYILVYSVTSIKSFEVIKVI

SEQ ID NO: 1433 - protein, 40 aa, Artificial Sequence
  Description of Artificial Sequence: Synthetic polypeptide
DEHTRRELAKMKQEPVKPEEGRDMANRIGAFGYMECSTKT

SEQ ID NO: 1434 - protein, 40 aa, Artificial Sequence
  Description of Artificial Sequence: Synthetic polypeptide
RRELAKMKQEPVKPEEGRDMANRIGAFGYMECSTKTKDGV

SEQ ID NO: 1435 - protein, 40 aa, Artificial Sequence
  Description of Artificial Sequence: Synthetic polypeptide
KMKQEPVKPEEGRDMANRIGAFGYMECSTKTKDGVREVFE

SEQ ID NO: 1436 - protein, 40 aa, Artificial Sequence
  Description of Artificial Sequence: Synthetic polypeptide
AAIRKKLVIVGDGACAKTCLLIVFSKDQFPEVYVPTVFEN

SEQ ID NO: 1437 - protein, 40 aa, Artificial Sequence
  Description of Artificial Sequence: Synthetic polypeptide
AKTCLLIVFSKDQFPEVYVPTVFENYVADIEVDGKQVELA

SEQ ID NO: 1438 - protein, 40 aa, Artificial Sequence
  Description of Artificial Sequence: Synthetic polypeptide
GACGKTCLRIVFSKDQFPEVYVPTVFENYVADIEVDGKQV

SEQ ID NO: 1439 - protein, 40 aa, Artificial Sequence
  Description of Artificial Sequence: Synthetic polypeptide
KTCLRIVFSKDQFPEVYVPTVFENYVADIEVDGKQVELAL

SEQ ID NO: 1440 - protein, 40 aa, Artificial Sequence
  Description of Artificial Sequence: Synthetic polypeptide
LRIVFSKDQFPEVYVPTVFENYVADIEVDGKQVELALWDT

SEQ ID NO: 1441 - protein, 40 aa, Artificial Sequence
  Description of Artificial Sequence: Synthetic polypeptide
RIVFSKDQFPEVYVPTVFENYVADIEVDGKQVELALWDTA

SEQ ID NO: 1442 - protein, 40 aa, Artificial Sequence
  Description of Artificial Sequence: Synthetic polypeptide
GDGACGKTCLLIVFSKDQFPEVYVPIVFENYVADIEVDGK

SEQ ID NO: 1443 - protein, 40 aa, Artificial Sequence
  Description of Artificial Sequence: Synthetic polypeptide
GACGKTCLLIVFSKDQFPEVYVPIVFENYVADIEVDGKQV

SEQ ID NO: 1444 - protein, 40 aa, Artificial Sequence
  Description of Artificial Sequence: Synthetic polypeptide
LLIVFSKDQFPEVYVPIVFENYVADIEVDGKQVELALWDT

SEQ ID NO: 1445 - protein, 40 aa, Artificial Sequence
  Description of Artificial Sequence: Synthetic polypeptide
FSKDQFPEVYVPIVFENYVADIEVDGKQVELALWDTAGQE

SEQ ID NO: 1446 - protein, 40 aa, Artificial Sequence
  Description of Artificial Sequence: Synthetic polypeptide
GACGKTCLLIVFSKDQFPEVYVPTVFENCVADIEVDGKQV

SEQ ID NO: 1447 - protein, 40 aa, Artificial Sequence
  Description of Artificial Sequence: Synthetic polypeptide
LIVFSKDQFPEVYVPTVFENCVADIEVDGKQVELALWDTA

SEQ ID NO: 1448 - protein, 40 aa, Artificial Sequence
  Description of Artificial Sequence: Synthetic polypeptide
KDQFPEVYVPTVFENCVADIEVDGKQVELALWDTAGQEDY

SEQ ID NO: 1449 - protein, 40 aa, Artificial Sequence
  Description of Artificial Sequence: Synthetic polypeptide
QFPEVYVPTVFENCVADIEVDGKQVELALWDTAGQEDYDR

SEQ ID NO: 1450 - protein, 40 aa, Artificial Sequence
  Description of Artificial Sequence: Synthetic polypeptide
FPEVYVPTVFENCVADIEVDGKQVELALWDTAGQEDYDRL

SEQ ID NO: 1451 - protein, 40 aa, Artificial Sequence
  Description of Artificial Sequence: Synthetic polypeptide
KTCLLIVFSKDQFPEVYVPTVFENYVADIKVDGKQVELAL

SEQ ID NO: 1452 - protein, 40 aa, Artificial Sequence
  Description of Artificial Sequence: Synthetic polypeptide
VFSKDQFPEVYVPTVFENYVADIKVDGKQVELALWDTAGQ

SEQ ID NO: 1453 - protein, 40 aa, Artificial Sequence
  Description of Artificial Sequence: Synthetic polypeptide
FSKDQFPEVYVPTVFENYVADIKVDGKQVELALWDTAGQE

SEQ ID NO: 1454 - protein, 40 aa, Artificial Sequence
  Description of Artificial Sequence: Synthetic polypeptide
KDQFPEVYVPTVFENYVADIKVDGKQVELALWDTAGQEDY

SEQ ID NO: 1455 - protein, 40 aa, Artificial Sequence
  Description of Artificial Sequence: Synthetic polypeptide
FPEVYVPTVFENYVADIKVDGKQVELALWDTAGQEDYDRL

SEQ ID NO: 1456 - protein, 40 aa, Artificial Sequence
  Description of Artificial Sequence: Synthetic polypeptide
PEVYVPTVFENYVADIKVDGKQVELALWDTAGQEDYDRLR

SEQ ID NO: 1457 - protein, 40 aa, Artificial Sequence
  Description of Artificial Sequence: Synthetic polypeptide
ENYVADIKVDGKQVELALWDTAGQEDYDRLRPLSYPDTDV

SEQ ID NO: 1458 - protein, 40 aa, Artificial Sequence
  Description of Artificial Sequence: Synthetic polypeptide
ADIKVDGKQVELALWDTAGQEDYDRLRPLSYPDTDVILMC

SEQ ID NO: 1459 - protein, 40 aa, Artificial Sequence
  Description of Artificial Sequence: Synthetic polypeptide
VFSKDQFPEVYVPTVFENYVADIEVDGKQVELALWGTAGQ

SEQ ID NO: 1460 - protein, 40 aa, Artificial Sequence
  Description of Artificial Sequence: Synthetic polypeptide
PEVYVPTVFENYVADIEVDGKQVELALWGTAGQEDYDRLR

SEQ ID NO: 1461 - protein, 40 aa, Artificial Sequence
  Description of Artificial Sequence: Synthetic polypeptide
VYVPTVFENYVADIEVDGKQVELALWGTAGQEDYDRLRPL

SEQ ID NO: 1462 - protein, 40 aa, Artificial Sequence
  Description of Artificial Sequence: Synthetic polypeptide
EVDGKQVELALWGTAGQEDYDRLRPLSYPDTDVILMCFSI

SEQ ID NO: 1463 - protein, 40 aa, Artificial Sequence
  Description of Artificial Sequence: Synthetic polypeptide
VFSKDQFPEVYVPTVFENYVADIEVDGKQVELALWYTAGQ

SEQ ID NO: 1464 - protein, 40 aa, Artificial Sequence
  Description of Artificial Sequence: Synthetic polypeptide
PEVYVPTVFENYVADIEVDGKQVELALWYTAGQEDYDRLR

SEQ ID NO: 1465 - protein, 40 aa, Artificial Sequence
  Description of Artificial Sequence: Synthetic polypeptide
VYVPTVFENYVADIEVDGKQVELALWYTAGQEDYDRLRPL

SEQ ID NO: 1466 - protein, 40 aa, Artificial Sequence
  Description of Artificial Sequence: Synthetic polypeptide
VPTVFENYVADIEVDGKQVELALWYTAGQEDYDRLRPLSY

SEQ ID NO: 1467 - protein, 40 aa, Artificial Sequence
  Description of Artificial Sequence: Synthetic polypeptide
ENYVADIEVDGKQVELALWYTAGQEDYDRLRPLSYPDTDV

SEQ ID NO: 1468 - protein, 40 aa, Artificial Sequence
  Description of Artificial Sequence: Synthetic polypeptide
YVADIEVDGKQVELALWYTAGQEDYDRLRPLSYPDTDVIL

SEQ ID NO: 1469 - protein, 40 aa, Artificial Sequence
  Description of Artificial Sequence: Synthetic polypeptide
ADIEVDGKQVELALWYTAGQEDYDRLRPLSYPDTDVILMC

SEQ ID NO: 1470 - protein, 40 aa, Artificial Sequence
  Description of Artificial Sequence: Synthetic polypeptide
EVDGKQVELALWYTAGQEDYDRLRPLSYPDTDVILMCFSI

SEQ ID NO: 1471 - protein, 40 aa, Artificial Sequence
  Description of Artificial Sequence: Synthetic polypeptide
ALWYTAGQEDYDRLRPLSYPDTDVILMCFSIDSPDSLENI

SEQ ID NO: 1472 - protein, 40 aa, Artificial Sequence
  Description of Artificial Sequence: Synthetic polypeptide
LWYTAGQEDYDRLRPLSYPDTDVILMCFSIDSPDSLENIP

SEQ ID NO: 1473 - protein, 40 aa, Artificial Sequence
  Description of Artificial Sequence: Synthetic polypeptide
PEVYVPTVFENYVADIEVDGKQVELALWDKAGQEDYDRLR

SEQ ID NO: 1474 - protein, 40 aa, Artificial Sequence
  Description of Artificial Sequence: Synthetic polypeptide
EVYVPTVFENYVADIEVDGKQVELALWDKAGQEDYDRLRP

SEQ ID NO: 1475 - protein, 40 aa, Artificial Sequence
  Description of Artificial Sequence: Synthetic polypeptide
VPTVFENYVADIEVDGKQVELALWDKAGQEDYDRLRPLSY

SEQ ID NO: 1476 - protein, 40 aa, Artificial Sequence
  Description of Artificial Sequence: Synthetic polypeptide
VFENYVADIEVDGKQVELALWDKAGQEDYDRLRPLSYPDT

SEQ ID NO: 1477 - protein, 40 aa, Artificial Sequence
  Description of Artificial Sequence: Synthetic polypeptide
ENYVADIEVDGKQVELALWDKAGQEDYDRLRPLSYPDTDV

SEQ ID NO: 1478 - protein, 40 aa, Artificial Sequence
  Description of Artificial Sequence: Synthetic polypeptide
ADIEVDGKQVELALWDKAGQEDYDRLRPLSYPDTDVILMC

SEQ ID NO: 1479 - protein, 40 aa, Artificial Sequence
  Description of Artificial Sequence: Synthetic polypeptide
DKAGQEDYDRLRPLSYPDTDVILMCFSIDSPDSLENIPEK

SEQ ID NO: 1480 - protein, 40 aa, Artificial Sequence
  Description of Artificial Sequence: Synthetic polypeptide
LIVFSKDQFPEVYVPTVFENYVADIEVDGKQVELALWDTD

SEQ ID NO: 1481 - protein, 40 aa, Artificial Sequence
  Description of Artificial Sequence: Synthetic polypeptide
FSKDQFPEVYVPTVFENYVADIEVDGKQVELALWDTDGQE

SEQ ID NO: 1482 - protein, 40 aa, Artificial Sequence
  Description of Artificial Sequence: Synthetic polypeptide
KDQFPEVYVPTVFENYVADIEVDGKQVELALWDTDGQEDY

SEQ ID NO: 1483 - protein, 40 aa, Artificial Sequence
  Description of Artificial Sequence: Synthetic polypeptide
VPTVFENYVADIEVDGKQVELALWDTDGQEDYDRLRPLSY

SEQ ID NO: 1484 - protein, 40 aa, Artificial Sequence
  Description of Artificial Sequence: Synthetic polypeptide
YVADIEVDGKQVELALWDTDGQEDYDRLRPLSYPDTDVIL

SEQ ID NO: 1485 - protein, 40 aa, Artificial Sequence
  Description of Artificial Sequence: Synthetic polypeptide
ADIEVDGKQVELALWDTDGQEDYDRLRPLSYPDTDVILMC

SEQ ID NO: 1486 - protein, 40 aa, Artificial Sequence
  Description of Artificial Sequence: Synthetic polypeptide
LWDTDGQEDYDRLRPLSYPDTDVILMCFSIDSPDSLENIP

SEQ ID NO: 1487 - protein, 40 aa, Artificial Sequence
  Description of Artificial Sequence: Synthetic polypeptide
WDTDGQEDYDRLRPLSYPDTDVILMCFSIDSPDSLENIPE

SEQ ID NO: 1488 - protein, 40 aa, Artificial Sequence
  Description of Artificial Sequence: Synthetic polypeptide
QFPEVYVPTVFENYVADIEVDGKQVELALWDTAEQEDYDR

SEQ ID NO: 1489 - protein, 40 aa, Artificial Sequence
  Description of Artificial Sequence: Synthetic polypeptide
FPEVYVPTVFENYVADIEVDGKQVELALWDTAEQEDYDRL

SEQ ID NO: 1490 - protein, 40 aa, Artificial Sequence
  Description of Artificial Sequence: Synthetic polypeptide
QVELALWDTAEQEDYDRLRPLSYPDTDVILMCFSIDSPDS

SEQ ID NO: 1491 - protein, 40 aa, Artificial Sequence
  Description of Artificial Sequence: Synthetic polypeptide
DQFPEVYVPTVFENYVADIEVDGKQVELALWDTARQEDYD

SEQ ID NO: 1492 - protein, 40 aa, Artificial Sequence
  Description of Artificial Sequence: Synthetic polypeptide
ENYVADIEVDGKQVELALWDTARQEDYDRLRPLSYPDTDV

SEQ ID NO: 1493 - protein, 40 aa, Artificial Sequence
  Description of Artificial Sequence: Synthetic polypeptide
YVADIEVDGKQVELALWDTARQEDYDRLRPLSYPDTDVIL

SEQ ID NO: 1494 - protein, 40 aa, Artificial Sequence
  Description of Artificial Sequence: Synthetic polypeptide
VADIEVDGKQVELALWDTARQEDYDRLRPLSYPDTDVILM

SEQ ID NO: 1495 - protein, 40 aa, Artificial Sequence
  Description of Artificial Sequence: Synthetic polypeptide
ADIEVDGKQVELALWDTARQEDYDRLRPLSYPDTDVILMC

SEQ ID NO: 1496 - protein, 40 aa, Artificial Sequence
  Description of Artificial Sequence: Synthetic polypeptide
VYVPTVFENYVADIEVDGKQVELALWDTAGKEDYDRLRPL

SEQ ID NO: 1497 - protein, 40 aa, Artificial Sequence
  Description of Artificial Sequence: Synthetic polypeptide
VPTVFENYVADIEVDGKQVELALWDTAGKEDYDRLRPLSY

SEQ ID NO: 1498 - protein, 40 aa, Artificial Sequence
  Description of Artificial Sequence: Synthetic polypeptide
QVELALWDTAGKEDYDRLRPLSYPDTDVILMCFSIDSPDS

SEQ ID NO: 1499 - protein, 40 aa, Artificial Sequence
  Description of Artificial Sequence: Synthetic polypeptide
VPTVFENYVADIEVDGKQVELALWDTAGQEDYDRLSPLSY

SEQ ID NO: 1500 - protein, 40 aa, Artificial Sequence
  Description of Artificial Sequence: Synthetic polypeptide
PTVFENYVADIEVDGKQVELALWDTAGQEDYDRLSPLSYP

SEQ ID NO: 1501 - protein, 40 aa, Artificial Sequence
  Description of Artificial Sequence: Synthetic polypeptide
ENYVADIEVDGKQVELALWDTAGQEDYDRLSPLSYPDTDV

SEQ ID NO: 1502 - protein, 40 aa, Artificial Sequence
  Description of Artificial Sequence: Synthetic polypeptide
VADIEVDGKQVELALWDTAGQEDYDRLSPLSYPDTDVILM

SEQ ID NO: 1503 - protein, 40 aa, Artificial Sequence
  Description of Artificial Sequence: Synthetic polypeptide
EVDGKQVELALWDTAGQEDYDRLSPLSYPDTDVILMCFSI

SEQ ID NO: 1504 - protein, 40 aa, Artificial Sequence
  Description of Artificial Sequence: Synthetic polypeptide
NYVADIEVDGKQVELALWDTAGQEDYDRLRPLPYPDTDVI

SEQ ID NO: 1505 - protein, 40 aa, Artificial Sequence
  Description of Artificial Sequence: Synthetic polypeptide
VADIEVDGKQVELALWDTAGQEDYDRLRPLPYPDTDVILM

SEQ ID NO: 1506 - protein, 40 aa, Artificial Sequence
  Description of Artificial Sequence: Synthetic polypeptide
EVDGKQVELALWDTAGQEDYDRLRPLPYPDTDVILMCFSI

SEQ ID NO: 1507 - protein, 40 aa, Artificial Sequence
  Description of Artificial Sequence: Synthetic polypeptide
RPLPYPDTDVILMCFSIDSPDSLENIPEKWTPEVKHFCPN

SEQ ID NO: 1508 - protein, 40 aa, Artificial Sequence
  Description of Artificial Sequence: Synthetic polypeptide
PLPYPDTDVILMCFSIDSPDSLENIPEKWTPEVKHFCPNV

SEQ ID NO: 1509 - protein, 40 aa, Artificial Sequence
  Description of Artificial Sequence: Synthetic polypeptide
PTIEDSYTKQCVIDDRAARLDILDTAGHEEFGAMREQYMR

SEQ ID NO: 1510 - protein, 40 aa, Artificial Sequence
  Description of Artificial Sequence: Synthetic polypeptide
TAGHEEFGAMREQYMRTGEGFLLVFSVTDRGSFEEIYKFQ

SEQ ID NO: 1511 - protein, 40 aa, Artificial Sequence
  Description of Artificial Sequence: Synthetic polypeptide
DDRAARLDILDTAGLEEFGAMREQYMRTGEGFLLVFSVTD

SEQ ID NO: 1512 - protein, 40 aa, Artificial Sequence
  Description of Artificial Sequence: Synthetic polypeptide
ARLDILDTAGLEEFGAMREQYMRTGEGFLLVFSVTDRGSF

SEQ ID NO: 1513 - protein, 40 aa, Artificial Sequence
  Description of Artificial Sequence: Synthetic polypeptide
DTAGLEEFGAMREQYMRTGEGFLLVFSVTDRGSFEEIYKF

SEQ ID NO: 1514 - protein, 40 aa, Artificial Sequence
  Description of Artificial Sequence: Synthetic polypeptide
GLEEFGAMREQYMRTGEGFLLVFSVTDRGSFEEIYKFQRQ

SEQ ID NO: 1515 - protein, 40 aa, Artificial Sequence
  Description of Artificial Sequence: Synthetic polypeptide
LVRTDSPNFLCSVLPTHWLCNKTLPIAFKVVALGDVPDGT

SEQ ID NO: 1516 - protein, 40 aa, Artificial Sequence
  Description of Artificial Sequence: Synthetic polypeptide
RTDSPNFLCSVLPTHWLCNKTLPIAFKVVALGDVPDGTLV

SEQ ID NO: 1517 - protein, 40 aa, Artificial Sequence
  Description of Artificial Sequence: Synthetic polypeptide
EVLADHPGELVRTDSPNFLCSVLPTHWRCNNTLPIAFKVV

SEQ ID NO: 1518 - protein, 40 aa, Artificial Sequence
  Description of Artificial Sequence: Synthetic polypeptide
ADHPGELVRTDSPNFLCSVLPTHWRCNNTLPIAFKVVALG

SEQ ID NO: 1519 - protein, 40 aa, Artificial Sequence
  Description of Artificial Sequence: Synthetic polypeptide
DERAQGEIACGEDCLNRLLMIECSSRCPNGDYCSNRQFQR

SEQ ID NO: 1520 - protein, 40 aa, Artificial Sequence
  Description of Artificial Sequence: Synthetic polypeptide
ERAQGEIACGEDCLNRLLMIECSSRCPNGDYCSNRQFQRK

SEQ ID NO: 1521 - protein, 40 aa, Artificial Sequence
  Description of Artificial Sequence: Synthetic polypeptide
RLLMIECSSRCPNGDYCSNRQFQRKQHADVEVILTEKKGW

SEQ ID NO: 1522 - protein, 40 aa, Artificial Sequence
  Description of Artificial Sequence: Synthetic polypeptide
LMIECSSRCPNGDYCSNRQFQRKQHADVEVILTEKKGWGL

SEQ ID NO: 1523 - protein, 40 aa, Artificial Sequence
  Description of Artificial Sequence: Synthetic polypeptide
CGEVLDHKEFKARVKEYARNKNIRYYFMALKNDEIIDATQ

SEQ ID NO: 1524 - protein, 40 aa, Artificial Sequence
  Description of Artificial Sequence: Synthetic polypeptide
VKEYARNKNIRYYFMALKNDEIIDATQKGNCSRFMNHSCE

SEQ ID NO: 1525 - protein, 40 aa, Artificial Sequence
  Description of Artificial Sequence: Synthetic polypeptide
NKNIHYYFMALKNDEIIDATQKGNCSCFMNHSCEPNCETQ

SEQ ID NO: 1526 - protein, 40 aa, Artificial Sequence
  Description of Artificial Sequence: Synthetic polypeptide
KNIHYYFMALKNDEIIDATQKGNCSCFMNHSCEPNCETQK

SEQ ID NO: 1527 - protein, 40 aa, Artificial Sequence
  Description of Artificial Sequence: Synthetic polypeptide
NCSCFMNHSCEPNCETQKWTVNGQLRVGFFTTKLVPSGSE

SEQ ID NO: 1528 - protein, 40 aa, Artificial Sequence
  Description of Artificial Sequence: Synthetic polypeptide
ALKNDEIIDATQKGNCSLFMNHSCEPNCETQKWTVNGQLR

SEQ ID NO: 1529 - protein, 40 aa, Artificial Sequence
  Description of Artificial Sequence: Synthetic polypeptide
LFMNHSCEPNCETQKWTVNGQLRVGFFTTKLVPSGSELTF

SEQ ID NO: 1530 - protein, 40 aa, Artificial Sequence
  Description of Artificial Sequence: Synthetic polypeptide
YARNKNIHYYFMALKNDEIIDATQKGNCSRFMTHSCEPNC

SEQ ID NO: 1531 - protein, 40 aa, Artificial Sequence
  Description of Artificial Sequence: Synthetic polypeptide
RNKNIHYYFMALKNDEIIDATQKGNCSRFMTHSCEPNCET

SEQ ID NO: 1532 - protein, 40 aa, Artificial Sequence
  Description of Artificial Sequence: Synthetic polypeptide
NKNIHYYFMALKNDEIIDATQKGNCSRFMTHSCEPNCETQ

SEQ ID NO: 1533 - protein, 40 aa, Artificial Sequence
  Description of Artificial Sequence: Synthetic polypeptide
YARVEGREIISNLAKAAGLATMISTMRPDIDNMDEYVCNT

SEQ ID NO: 1534 - protein, 40 aa, Artificial Sequence
  Description of Artificial Sequence: Synthetic polypeptide
GREIISNLAKAAGLATMISTMRPDIDNMDEYVCNTTARAF

SEQ ID NO: 1535 - protein, 40 aa, Artificial Sequence
  Description of Artificial Sequence: Synthetic polypeptide
DEYVCNTTARAFAVVASALGIPSLLPFLKAVCKSKKSWQA

SEQ ID NO: 1536 - protein, 40 aa, Artificial Sequence
  Description of Artificial Sequence: Synthetic polypeptide
ARVEGREIISNLAKAAGLATMISTMRPDIDNMDEYVHNTT

SEQ ID NO: 1537 - protein, 40 aa, Artificial Sequence
  Description of Artificial Sequence: Synthetic polypeptide
EGREIISNLAKAAGLATMISTMRPDIDNMDEYVHNTTARA

SEQ ID NO: 1538 - protein, 40 aa, Artificial Sequence
  Description of Artificial Sequence: Synthetic polypeptide
ISNLAKAAGLATMISTMRPDIDNMDEYVHNTTARAFAVVA

SEQ ID NO: 1539 - protein, 40 aa, Artificial Sequence
  Description of Artificial Sequence: Synthetic polypeptide
STMRPDIDNMDEYVHNTTARAFAVVASALGIPSLLPFLKA

SEQ ID NO: 1540 - protein, 40 aa, Artificial Sequence
  Description of Artificial Sequence: Synthetic polypeptide
LATMISTMRPDIDNMDEYVRYTTARAFAVVASALGIPSLL

SEQ ID NO: 1541 - protein, 40 aa, Artificial Sequence
  Description of Artificial Sequence: Synthetic polypeptide
ATMISTMRPDIDNMDEYVRYTTARAFAVVASALGIPSLLP

SEQ ID NO: 1542 - protein, 40 aa, Artificial Sequence
  Description of Artificial Sequence: Synthetic polypeptide
PDIDNMDEYVRYTTARAFAVVASALGIPSLLPFLKAVCKS

SEQ ID NO: 1543 - protein, 40 aa, Artificial Sequence
  Description of Artificial Sequence: Synthetic polypeptide
ARHTGIEIVQQIAILMGCAILPHLRSLVEIIEHGLVDEQQ

SEQ ID NO: 1544 - protein, 40 aa, Artificial Sequence
  Description of Artificial Sequence: Synthetic polypeptide
EIVQQIAILMGCAILPHLRSLVEIIEHGLVDEQQKVRTIS

SEQ ID NO: 1545 - protein, 40 aa, Artificial Sequence
  Description of Artificial Sequence: Synthetic polypeptide
KSWQARHTGINIVQQIAILMGCAILPHLRSLVEIIEHGLV

SEQ ID NO: 1546 - protein, 40 aa, Artificial Sequence
  Description of Artificial Sequence: Synthetic polypeptide
QARHTGINIVQQIAILMGCAILPHLRSLVEIIEHGLVDEQ

SEQ ID NO: 1547 - protein, 40 aa, Artificial Sequence
  Description of Artificial Sequence: Synthetic polypeptide
RHTGINIVQQIAILMGCAILPHLRSLVEIIEHGLVDEQQK

SEQ ID NO: 1548 - protein, 40 aa, Artificial Sequence
  Description of Artificial Sequence: Synthetic polypeptide
KSWQARHTGITIVQQIAILMGCAILPHLRSLVEIIEHGLV

SEQ ID NO: 1549 - protein, 40 aa, Artificial Sequence
  Description of Artificial Sequence: Synthetic polypeptide
WQARHTGITIVQQIAILMGCAILPHLRSLVEIIEHGLVDE

SEQ ID NO: 1550 - protein, 40 aa, Artificial Sequence
  Description of Artificial Sequence: Synthetic polypeptide
ARHTGITIVQQIAILMGCAILPHLRSLVEIIEHGLVDEQQ

SEQ ID NO: 1551 - protein, 40 aa, Artificial Sequence
  Description of Artificial Sequence: Synthetic polypeptide
GITIVQQIAILMGCAILPHLRSLVEIIEHGLVDEQQKVRT

SEQ ID NO: 1552 - protein, 40 aa, Artificial Sequence
  Description of Artificial Sequence: Synthetic polypeptide
RHTGIKIVQQIAILMGCAILPHLRSLVEIIEHGLVDEQQE

SEQ ID NO: 1553 - protein, 40 aa, Artificial Sequence
  Description of Artificial Sequence: Synthetic polypeptide
GLVDEQQEVRTISALAIAALAEAATPYGIESFDSVLKPLW

SEQ ID NO: 1554 - protein, 40 aa, Artificial Sequence
  Description of Artificial Sequence: Synthetic polypeptide
LVDEQQEVRTISALAIAALAEAATPYGIESFDSVLKPLWK

SEQ ID NO: 1555 - protein, 40 aa, Artificial Sequence
  Description of Artificial Sequence: Synthetic polypeptide
IAALAEAATPYGIESFDSVLKPLWKGIRQHRGEGLAAFLK

SEQ ID NO: 1556 - protein, 40 aa, Artificial Sequence
  Description of Artificial Sequence: Synthetic polypeptide
AEAATPYGIESFDSVLKPLWKGIRQHRGEGLAAFLKAIGY

SEQ ID NO: 1557 - protein, 40 aa, Artificial Sequence
  Description of Artificial Sequence: Synthetic polypeptide
EAATPYGIESFDSVLKPLWKGIRQHRGEGLAAFLKAIGYL

SEQ ID NO: 1558 - protein, 40 aa, Artificial Sequence
  Description of Artificial Sequence: Synthetic polypeptide
AATPYGIESFDSVLKPLWKGIRQHRGEGLAAFLKAIGYLI

SEQ ID NO: 1559 - protein, 40 aa, Artificial Sequence
  Description of Artificial Sequence: Synthetic polypeptide
TPYGIESFDSVLKPLWKGIRQHRGEGLAAFLKAIGYLIPL

SEQ ID NO: 1560 - protein, 40 aa, Artificial Sequence
  Description of Artificial Sequence: Synthetic polypeptide
YGIESFDSVLKPLWKGIRQHRGEGLAAFLKAIGYLIPLMD

SEQ ID NO: 1561 - protein, 40 aa, Artificial Sequence
  Description of Artificial Sequence: Synthetic polypeptide
IESFDSVLKPLWKGIRQHRGEGLAAFLKAIGYLIPLMDAE

SEQ ID NO: 1562 - protein, 40 aa, Artificial Sequence
  Description of Artificial Sequence: Synthetic polypeptide
SVLKPLWKGIRQHRGEGLAAFLKAIGYLIPLMDAEYANYY

SEQ ID NO: 1563 - protein, 40 aa, Artificial Sequence
  Description of Artificial Sequence: Synthetic polypeptide
PLWKGIRQHRGEGLAAFLKAIGYLIPLMDAEYANYYTREV

SEQ ID NO: 1564 - protein, 40 aa, Artificial Sequence
  Description of Artificial Sequence: Synthetic polypeptide
GIRQHRGEGLAAFLKAIGYLIPLMDAEYANYYTREVMLIL

SEQ ID NO: 1565 - protein, 40 aa, Artificial Sequence
  Description of Artificial Sequence: Synthetic polypeptide
RQHRGEGLAAFLKAIGYLIPLMDAEYANYYTREVMLILIR

SEQ ID NO: 1566 - protein, 40 aa, Artificial Sequence
  Description of Artificial Sequence: Synthetic polypeptide
GEGLAAFLKAIGYLIPLMDAEYANYYTREVMLILIREFQS

SEQ ID NO: 1567 - protein, 40 aa, Artificial Sequence
  Description of Artificial Sequence: Synthetic polypeptide
EGLAAFLKAIGYLIPLMDAEYANYYTREVMLILIREFQSP

SEQ ID NO: 1568 - protein, 40 aa, Artificial Sequence
  Description of Artificial Sequence: Synthetic polypeptide
GKGLAAVLKAIGYLIPLMDAEYANYYTREVMLILIREFQS

SEQ ID NO: 1569 - protein, 40 aa, Artificial Sequence
  Description of Artificial Sequence: Synthetic polypeptide
GLAAVLKAIGYLIPLMDAEYANYYTREVMLILIREFQSPD

SEQ ID NO: 1570 - protein, 40 aa, Artificial Sequence
  Description of Artificial Sequence: Synthetic polypeptide
LAAVLKAIGYLIPLMDAEYANYYTREVMLILIREFQSPDE

SEQ ID NO: 1571 - protein, 40 aa, Artificial Sequence
  Description of Artificial Sequence: Synthetic polypeptide
ISRIVDDLKDEAKQYRKMVMETIEKIMGNLGAADIDHKLE

SEQ ID NO: 1572 - protein, 40 aa, Artificial Sequence
  Description of Artificial Sequence: Synthetic polypeptide
VDDLKDEAKQYRKMVMETIEKIMGNLGAADIDHKLEEQLI

SEQ ID NO: 1573 - protein, 40 aa, Artificial Sequence
  Description of Artificial Sequence: Synthetic polypeptide
LKDEAKQYRKMVMETIEKIMGNLGAADIDHKLEEQLIDGI

SEQ ID NO: 1574 - protein, 40 aa, Artificial Sequence
  Description of Artificial Sequence: Synthetic polypeptide
EAKQYRKMVMETIEKIMGNLGAADIDHKLEEQLIDGILYA

SEQ ID NO: 1575 - protein, 40 aa, Artificial Sequence
  Description of Artificial Sequence: Synthetic polypeptide
QYRKMVMETIEKIMGNLGAADIDHKLEEQLIDGILYAFQG

SEQ ID NO: 1576 - protein, 40 aa, Artificial Sequence
  Description of Artificial Sequence: Synthetic polypeptide
KMVMETIEKIMGNLGAADIDHKLEEQLIDGILYAFQGQTT

SEQ ID NO: 1577 - protein, 40 aa, Artificial Sequence
  Description of Artificial Sequence: Synthetic polypeptide
MVMETIEKIMGNLGAADIDHKLEEQLIDGILYAFQGQTTE

SEQ ID NO: 1578 - protein, 40 aa, Artificial Sequence
  Description of Artificial Sequence: Synthetic polypeptide
AADIDHKLEEQLIDGILYAFQGQTTEDSVMLNGFGTVVNA

SEQ ID NO: 1579 - protein, 40 aa, Artificial Sequence
  Description of Artificial Sequence: Synthetic polypeptide
LEEQLIDGILYAFQGQTTEDSVMLNGFGTVVNALGKRVKP

SEQ ID NO: 1580 - protein, 40 aa, Artificial Sequence
  Description of Artificial Sequence: Synthetic polypeptide
QLIDGILYAFQGQTTEDSVMLNGFGTVVNALGKRVKPYLP

SEQ ID NO: 1581 - protein, 40 aa, Artificial Sequence
  Description of Artificial Sequence: Synthetic polypeptide
GILYAFQGQTTEDSVMLNGFGTVVNALGKRVKPYLPQICG

SEQ ID NO: 1582 - protein, 40 aa, Artificial Sequence
  Description of Artificial Sequence: Synthetic polypeptide
KMVMETIEKIMGNLGAADIDHKLEEQLIDGILYAFQKQTT

SEQ ID NO: 1583 - protein, 40 aa, Artificial Sequence
  Description of Artificial Sequence: Synthetic polypeptide
METIEKIMGNLGAADIDHKLEEQLIDGILYAFQKQTTEDS

SEQ ID NO: 1584 - protein, 40 aa, Artificial Sequence
  Description of Artificial Sequence: Synthetic polypeptide
ETIEKIMGNLGAADIDHKLEEQLIDGILYAFQKQTTEDSV

SEQ ID NO: 1585 - protein, 40 aa, Artificial Sequence
  Description of Artificial Sequence: Synthetic polypeptide
IEKIMGNLGAADIDHKLEEQLIDGILYAFQKQTTEDSVML

SEQ ID NO: 1586 - protein, 40 aa, Artificial Sequence
  Description of Artificial Sequence: Synthetic polypeptide
GILYAFQKQTTEDSVMLNGFGTVVNALGKRVKPYLPQICG

SEQ ID NO: 1587 - protein, 40 aa, Artificial Sequence
  Description of Artificial Sequence: Synthetic polypeptide
ETIEKIMGNLGAADIDHKLEEQLIDGILYAFQEPTTEDSV

SEQ ID NO: 1588 - protein, 40 aa, Artificial Sequence
  Description of Artificial Sequence: Synthetic polypeptide
EQLIDGILYAFQEPTTEDSVMLNGFGTVVNALGKRVKPYL

SEQ ID NO: 1589 - protein, 40 aa, Artificial Sequence
  Description of Artificial Sequence: Synthetic polypeptide
EPTTEDSVMLNGFGTVVNALGKRVKPYLPQICGTVLWRLN

SEQ ID NO: 1590 - protein, 40 aa, Artificial Sequence
  Description of Artificial Sequence: Synthetic polypeptide
RRQTVTSTPCWIELHLNGPLQWLEKVLTQMGSPSVRCSSM

SEQ ID NO: 1591 - protein, 40 aa, Artificial Sequence
  Description of Artificial Sequence: Synthetic polypeptide
EYRRQTVTSTPCWIELHLNGPLQWLNKVLTQMGSPSVRCS

SEQ ID NO: 1592 - protein, 40 aa, Artificial Sequence
  Description of Artificial Sequence: Synthetic polypeptide
YWPVHNELAFQPPISNHPAPEYWCSIAYFEMDVQVGETLK

SEQ ID NO: 1593 - protein, 40 aa, Artificial Sequence
  Description of Artificial Sequence: Synthetic polypeptide
VHNELAFQPPISNHPAPEYWCSIAYFEMDVQVGETLKVPS

SEQ ID NO: 1594 - protein, 40 aa, Artificial Sequence
  Description of Artificial Sequence: Synthetic polypeptide
AFQPPISNHPAPEYWCSIAYFEMDVQVGETLKVPSSCPIV

SEQ ID NO: 1595 - protein, 40 aa, Artificial Sequence
  Description of Artificial Sequence: Synthetic polypeptide
FQPPISNHPAPEYWCSIAYFEMDVQVGETLKVPSSCPIVT

SEQ ID NO: 1596 - protein, 40 aa, Artificial Sequence
  Description of Artificial Sequence: Synthetic polypeptide
PAPEYWCSIAYFEMDVQVGETLKVPSSCPIVTVDGYVDPS

SEQ ID NO: 1597 - protein, 40 aa, Artificial Sequence
  Description of Artificial Sequence: Synthetic polypeptide
CSIAYFEMDVQVGETLKVPSSCPIVTVDGYVDPSGGDRFC

SEQ ID NO: 1598 - protein, 40 aa, Artificial Sequence
  Description of Artificial Sequence: Synthetic polypeptide
FEMDVQVGETLKVPSSCPIVTVDGYVDPSGGDRFCLGQLS

SEQ ID NO: 1599 - protein, 40 aa, Artificial Sequence
  Description of Artificial Sequence: Synthetic polypeptide
LKVPSSCPIVTVDGYVDPSGGDRFCLGQLSNVHRTEAIER

SEQ ID NO: 1600 - protein, 40 aa, Artificial Sequence
  Description of Artificial Sequence: Synthetic polypeptide
PPISNHPAPEYWCSIAYFEMDVQVGETFKVPSSCPIVTVG

SEQ ID NO: 1601 - protein, 40 aa, Artificial Sequence
  Description of Artificial Sequence: Synthetic polypeptide
ISNHPAPEYWCSIAYFEMDVQVGETFKVPSSCPIVTVGGY

SEQ ID NO: 1602 - protein, 40 aa, Artificial Sequence
  Description of Artificial Sequence: Synthetic polypeptide
NHPAPEYWCSIAYFEMDVQVGETFKVPSSCPIVTVGGYVD

SEQ ID NO: 1603 - protein, 40 aa, Artificial Sequence
  Description of Artificial Sequence: Synthetic polypeptide
CSIAYFEMDVQVGETFKVPSSCPIVTVGGYVDPSGGDRFC

SEQ ID NO: 1604 - protein, 40 aa, Artificial Sequence
  Description of Artificial Sequence: Synthetic polypeptide
IAYFEMDVQVGETFKVPSSCPIVTVGGYVDPSGGDRFCLG

SEQ ID NO: 1605 - protein, 40 aa, Artificial Sequence
  Description of Artificial Sequence: Synthetic polypeptide
AYFEMDVQVGETFKVPSSCPIVTVGGYVDPSGGDRFCLGQ

SEQ ID NO: 1606 - protein, 40 aa, Artificial Sequence
  Description of Artificial Sequence: Synthetic polypeptide
VQVGETFKVPSSCPIVTVGGYVDPSGGDRFCLGQLSNVHR

SEQ ID NO: 1607 - protein, 40 aa, Artificial Sequence
  Description of Artificial Sequence: Synthetic polypeptide
SCPIVTVGGYVDPSGGDRFCLGQLSNVHRTEAIERARLHI

SEQ ID NO: 1608 - protein, 40 aa, Artificial Sequence
  Description of Artificial Sequence: Synthetic polypeptide
CPIVTVGGYVDPSGGDRFCLGQLSNVHRTEAIERARLHIG

SEQ ID NO: 1609 - protein, 40 aa, Artificial Sequence
  Description of Artificial Sequence: Synthetic polypeptide
PISNHPAPEYWCSIAYFEMDVQVGETFKVPSSCPIVTVHG

SEQ ID NO: 1610 - protein, 40 aa, Artificial Sequence
  Description of Artificial Sequence: Synthetic polypeptide
ISNHPAPEYWCSIAYFEMDVQVGETFKVPSSCPIVTVHGY

SEQ ID NO: 1611 - protein, 40 aa, Artificial Sequence
  Description of Artificial Sequence: Synthetic polypeptide
SNHPAPEYWCSIAYFEMDVQVGETFKVPSSCPIVTVHGYV

SEQ ID NO: 1612 - protein, 40 aa, Artificial Sequence
  Description of Artificial Sequence: Synthetic polypeptide
PEYWCSIAYFEMDVQVGETFKVPSSCPIVTVHGYVDPSGG

SEQ ID NO: 1613 - protein, 40 aa, Artificial Sequence
  Description of Artificial Sequence: Synthetic polypeptide
SIAYFEMDVQVGETFKVPSSCPIVTVHGYVDPSGGDRFCL

SEQ ID NO: 1614 - protein, 40 aa, Artificial Sequence
  Description of Artificial Sequence: Synthetic polypeptide
IAYFEMDVQVGETFKVPSSCPIVTVHGYVDPSGGDRFCLG

SEQ ID NO: 1615 - protein, 40 aa, Artificial Sequence
  Description of Artificial Sequence: Synthetic polypeptide
YFEMDVQVGETFKVPSSCPIVTVHGYVDPSGGDRFCLGQL

SEQ ID NO: 1616 - protein, 40 aa, Artificial Sequence
  Description of Artificial Sequence: Synthetic polypeptide
FEMDVQVGETFKVPSSCPIVTVHGYVDPSGGDRFCLGQLS

SEQ ID NO: 1617 - protein, 40 aa, Artificial Sequence
  Description of Artificial Sequence: Synthetic polypeptide
MDVQVGETFKVPSSCPIVTVHGYVDPSGGDRFCLGQLSNV

SEQ ID NO: 1618 - protein, 40 aa, Artificial Sequence
  Description of Artificial Sequence: Synthetic polypeptide
QVGETFKVPSSCPIVTVHGYVDPSGGDRFCLGQLSNVHRT

SEQ ID NO: 1619 - protein, 40 aa, Artificial Sequence
  Description of Artificial Sequence: Synthetic polypeptide
GETFKVPSSCPIVTVHGYVDPSGGDRFCLGQLSNVHRTEA

SEQ ID NO: 1620 - protein, 40 aa, Artificial Sequence
  Description of Artificial Sequence: Synthetic polypeptide
VPSSCPIVTVHGYVDPSGGDRFCLGQLSNVHRTEAIERAR

SEQ ID NO: 1621 - protein, 40 aa, Artificial Sequence
  Description of Artificial Sequence: Synthetic polypeptide
SCPIVTVHGYVDPSGGDRFCLGQLSNVHRTEAIERARLHI

SEQ ID NO: 1622 - protein, 40 aa, Artificial Sequence
  Description of Artificial Sequence: Synthetic polypeptide
SNHPAPEYWCSIAYFEMDVQVGETFKVPSSCPIVTVDRYV

SEQ ID NO: 1623 - protein, 40 aa, Artificial Sequence
  Description of Artificial Sequence: Synthetic polypeptide
APEYWCSIAYFEMDVQVGETFKVPSSCPIVTVDRYVDPSG

SEQ ID NO: 1624 - protein, 40 aa, Artificial Sequence
  Description of Artificial Sequence: Synthetic polypeptide
AYFEMDVQVGETFKVPSSCPIVTVDRYVDPSGGDRFCLGQ

SEQ ID NO: 1625 - protein, 40 aa, Artificial Sequence
  Description of Artificial Sequence: Synthetic polypeptide
EMDVQVGETFKVPSSCPIVTVDRYVDPSGGDRFCLGQLSN

SEQ ID NO: 1626 - protein, 40 aa, Artificial Sequence
  Description of Artificial Sequence: Synthetic polypeptide
MDVQVGETFKVPSSCPIVTVDRYVDPSGGDRFCLGQLSNV

SEQ ID NO: 1627 - protein, 40 aa, Artificial Sequence
  Description of Artificial Sequence: Synthetic polypeptide
DVQVGETFKVPSSCPIVTVDRYVDPSGGDRFCLGQLSNVH

SEQ ID NO: 1628 - protein, 40 aa, Artificial Sequence
  Description of Artificial Sequence: Synthetic polypeptide
VGETFKVPSSCPIVTVDRYVDPSGGDRFCLGQLSNVHRTE

SEQ ID NO: 1629 - protein, 40 aa, Artificial Sequence
  Description of Artificial Sequence: Synthetic polypeptide
VPSSCPIVTVDRYVDPSGGDRFCLGQLSNVHRTEAIERAR

SEQ ID NO: 1630 - protein, 40 aa, Artificial Sequence
  Description of Artificial Sequence: Synthetic polypeptide
ISNHPAPEYWCSIAYFEMDVQVGETFKVPSSCPIVTVDVY

SEQ ID NO: 1631 - protein, 40 aa, Artificial Sequence
  Description of Artificial Sequence: Synthetic polypeptide
APEYWCSIAYFEMDVQVGETFKVPSSCPIVTVDVYVDPSG

SEQ ID NO: 1632 - protein, 40 aa, Artificial Sequence
  Description of Artificial Sequence: Synthetic polypeptide
YWCSIAYFEMDVQVGETFKVPSSCPIVTVDVYVDPSGGDR

SEQ ID NO: 1633 - protein, 40 aa, Artificial Sequence
  Description of Artificial Sequence: Synthetic polypeptide
SIAYFEMDVQVGETFKVPSSCPIVTVDVYVDPSGGDRFCL

SEQ ID NO: 1634 - protein, 40 aa, Artificial Sequence
  Description of Artificial Sequence: Synthetic polypeptide
EMDVQVGETFKVPSSCPIVTVDVYVDPSGGDRFCLGQLSN

SEQ ID NO: 1635 - protein, 40 aa, Artificial Sequence
  Description of Artificial Sequence: Synthetic polypeptide
VQVGETFKVPSSCPIVTVDVYVDPSGGDRFCLGQLSNVHR

SEQ ID NO: 1636 - protein, 40 aa, Artificial Sequence
  Description of Artificial Sequence: Synthetic polypeptide
SNHPAPEYWCSIAYFEMDVQVGETFKVPSSCPIVTVDGCV

SEQ ID NO: 1637 - protein, 40 aa, Artificial Sequence
  Description of Artificial Sequence: Synthetic polypeptide
NHPAPEYWCSIAYFEMDVQVGETFKVPSSCPIVTVDGCVD

SEQ ID NO: 1638 - protein, 40 aa, Artificial Sequence
  Description of Artificial Sequence: Synthetic polypeptide
APEYWCSIAYFEMDVQVGETFKVPSSCPIVTVDGCVDPSG

SEQ ID NO: 1639 - protein, 40 aa, Artificial Sequence
  Description of Artificial Sequence: Synthetic polypeptide
EYWCSIAYFEMDVQVGETFKVPSSCPIVTVDGCVDPSGGD

SEQ ID NO: 1640 - protein, 40 aa, Artificial Sequence
  Description of Artificial Sequence: Synthetic polypeptide
YWCSIAYFEMDVQVGETFKVPSSCPIVTVDGCVDPSGGDR

SEQ ID NO: 1641 - protein, 40 aa, Artificial Sequence
  Description of Artificial Sequence: Synthetic polypeptide
WCSIAYFEMDVQVGETFKVPSSCPIVTVDGCVDPSGGDRF

SEQ ID NO: 1642 - protein, 40 aa, Artificial Sequence
  Description of Artificial Sequence: Synthetic polypeptide
IAYFEMDVQVGETFKVPSSCPIVTVDGCVDPSGGDRFCLG

SEQ ID NO: 1643 - protein, 40 aa, Artificial Sequence
  Description of Artificial Sequence: Synthetic polypeptide
YFEMDVQVGETFKVPSSCPIVTVDGCVDPSGGDRFCLGQL

SEQ ID NO: 1644 - protein, 40 aa, Artificial Sequence
  Description of Artificial Sequence: Synthetic polypeptide
DVQVGETFKVPSSCPIVTVDGCVDPSGGDRFCLGQLSNVH

SEQ ID NO: 1645 - protein, 40 aa, Artificial Sequence
  Description of Artificial Sequence: Synthetic polypeptide
VQVGETFKVPSSCPIVTVDGCVDPSGGDRFCLGQLSNVHR

SEQ ID NO: 1646 - protein, 40 aa, Artificial Sequence
  Description of Artificial Sequence: Synthetic polypeptide
GETFKVPSSCPIVTVDGCVDPSGGDRFCLGQLSNVHRTEA

SEQ ID NO: 1647 - protein, 40 aa, Artificial Sequence
  Description of Artificial Sequence: Synthetic polypeptide
CPIVTVDGCVDPSGGDRFCLGQLSNVHRTEAIERARLHIG

SEQ ID NO: 1648 - protein, 40 aa, Artificial Sequence
  Description of Artificial Sequence: Synthetic polypeptide
ISNHPAPEYWCSIAYFEMDVQVGETFKVPSSCPIVTVDGN

SEQ ID NO: 1649 - protein, 40 aa, Artificial Sequence
  Description of Artificial Sequence: Synthetic polypeptide
SNHPAPEYWCSIAYFEMDVQVGETFKVPSSCPIVTVDGNV

SEQ ID NO: 1650 - protein, 40 aa, Artificial Sequence
  Description of Artificial Sequence: Synthetic polypeptide
NHPAPEYWCSIAYFEMDVQVGETFKVPSSCPIVTVDGNVD

SEQ ID NO: 1651 - protein, 40 aa, Artificial Sequence
  Description of Artificial Sequence: Synthetic polypeptide
HPAPEYWCSIAYFEMDVQVGETFKVPSSCPIVTVDGNVDP

SEQ ID NO: 1652 - protein, 40 aa, Artificial Sequence
  Description of Artificial Sequence: Synthetic polypeptide
EYWCSIAYFEMDVQVGETFKVPSSCPIVTVDGNVDPSGGD

SEQ ID NO: 1653 - protein, 40 aa, Artificial Sequence
  Description of Artificial Sequence: Synthetic polypeptide
WCSIAYFEMDVQVGETFKVPSSCPIVTVDGNVDPSGGDRF

SEQ ID NO: 1654 - protein, 40 aa, Artificial Sequence
  Description of Artificial Sequence: Synthetic polypeptide
CSIAYFEMDVQVGETFKVPSSCPIVTVDGNVDPSGGDRFC

SEQ ID NO: 1655 - protein, 40 aa, Artificial Sequence
  Description of Artificial Sequence: Synthetic polypeptide
SIAYFEMDVQVGETFKVPSSCPIVTVDGNVDPSGGDRFCL

SEQ ID NO: 1656 - protein, 40 aa, Artificial Sequence
  Description of Artificial Sequence: Synthetic polypeptide
IAYFEMDVQVGETFKVPSSCPIVTVDGNVDPSGGDRFCLG

SEQ ID NO: 1657 - protein, 40 aa, Artificial Sequence
  Description of Artificial Sequence: Synthetic polypeptide
AYFEMDVQVGETFKVPSSCPIVTVDGNVDPSGGDRFCLGQ

SEQ ID NO: 1658 - protein, 40 aa, Artificial Sequence
  Description of Artificial Sequence: Synthetic polypeptide
EMDVQVGETFKVPSSCPIVTVDGNVDPSGGDRFCLGQLSN

SEQ ID NO: 1659 - protein, 40 aa, Artificial Sequence
  Description of Artificial Sequence: Synthetic polypeptide
MDVQVGETFKVPSSCPIVTVDGNVDPSGGDRFCLGQLSNV

SEQ ID NO: 1660 - protein, 40 aa, Artificial Sequence
  Description of Artificial Sequence: Synthetic polypeptide
DVQVGETFKVPSSCPIVTVDGNVDPSGGDRFCLGQLSNVH

SEQ ID NO: 1661 - protein, 40 aa, Artificial Sequence
  Description of Artificial Sequence: Synthetic polypeptide
NHPAPEYWCSIAYFEMDVQVGETFKVPSSCPIVTVDGYVV

SEQ ID NO: 1662 - protein, 40 aa, Artificial Sequence
  Description of Artificial Sequence: Synthetic polypeptide
HPAPEYWCSIAYFEMDVQVGETFKVPSSCPIVTVDGYVVP

SEQ ID NO: 1663 - protein, 40 aa, Artificial Sequence
  Description of Artificial Sequence: Synthetic polypeptide
APEYWCSIAYFEMDVQVGETFKVPSSCPIVTVDGYVVPSG

SEQ ID NO: 1664 - protein, 40 aa, Artificial Sequence
  Description of Artificial Sequence: Synthetic polypeptide
WCSIAYFEMDVQVGETFKVPSSCPIVTVDGYVVPSGGDRF

SEQ ID NO: 1665 - protein, 40 aa, Artificial Sequence
  Description of Artificial Sequence: Synthetic polypeptide
SIAYFEMDVQVGETFKVPSSCPIVTVDGYVVPSGGDRFCL

SEQ ID NO: 1666 - protein, 40 aa, Artificial Sequence
  Description of Artificial Sequence: Synthetic polypeptide
IAYFEMDVQVGETFKVPSSCPIVTVDGYVVPSGGDRFCLG

SEQ ID NO: 1667 - protein, 40 aa, Artificial Sequence
  Description of Artificial Sequence: Synthetic polypeptide
AYFEMDVQVGETFKVPSSCPIVTVDGYVVPSGGDRFCLGQ

SEQ ID NO: 1668 - protein, 40 aa, Artificial Sequence
  Description of Artificial Sequence: Synthetic polypeptide
FEMDVQVGETFKVPSSCPIVTVDGYVVPSGGDRFCLGQLS

SEQ ID NO: 1669 - protein, 40 aa, Artificial Sequence
  Description of Artificial Sequence: Synthetic polypeptide
MDVQVGETFKVPSSCPIVTVDGYVVPSGGDRFCLGQLSNV

SEQ ID NO: 1670 - protein, 40 aa, Artificial Sequence
  Description of Artificial Sequence: Synthetic polypeptide
VQVGETFKVPSSCPIVTVDGYVVPSGGDRFCLGQLSNVHR

SEQ ID NO: 1671 - protein, 40 aa, Artificial Sequence
  Description of Artificial Sequence: Synthetic polypeptide
PAPEYWCSIAYFEMDVQVGETFKVPSSCPIVTVDGYVYPS

SEQ ID NO: 1672 - protein, 40 aa, Artificial Sequence
  Description of Artificial Sequence: Synthetic polypeptide
APEYWCSIAYFEMDVQVGETFKVPSSCPIVTVDGYVYPSG

SEQ ID NO: 1673 - protein, 40 aa, Artificial Sequence
  Description of Artificial Sequence: Synthetic polypeptide
CSIAYFEMDVQVGETFKVPSSCPIVTVDGYVYPSGGDRFC

SEQ ID NO: 1674 - protein, 40 aa, Artificial Sequence
  Description of Artificial Sequence: Synthetic polypeptide
IAYFEMDVQVGETFKVPSSCPIVTVDGYVYPSGGDRFCLG

SEQ ID NO: 1675 - protein, 40 aa, Artificial Sequence
  Description of Artificial Sequence: Synthetic polypeptide
YFEMDVQVGETFKVPSSCPIVTVDGYVYPSGGDRFCLGQL

SEQ ID NO: 1676 - protein, 40 aa, Artificial Sequence
  Description of Artificial Sequence: Synthetic polypeptide
EMDVQVGETFKVPSSCPIVTVDGYVYPSGGDRFCLGQLSN

SEQ ID NO: 1677 - protein, 40 aa, Artificial Sequence
  Description of Artificial Sequence: Synthetic polypeptide
MDVQVGETFKVPSSCPIVTVDGYVYPSGGDRFCLGQLSNV

SEQ ID NO: 1678 - protein, 40 aa, Artificial Sequence
  Description of Artificial Sequence: Synthetic polypeptide
CPIVTVDGYVYPSGGDRFCLGQLSNVHRTEAIERARLHIG

SEQ ID NO: 1679 - protein, 40 aa, Artificial Sequence
  Description of Artificial Sequence: Synthetic polypeptide
HPAPEYWCSIAYFEMDVQVGETFKVPSSCPIVTVDGYVDL

SEQ ID NO: 1680 - protein, 40 aa, Artificial Sequence
  Description of Artificial Sequence: Synthetic polypeptide
PAPEYWCSIAYFEMDVQVGETFKVPSSCPIVTVDGYVDLS

SEQ ID NO: 1681 - protein, 40 aa, Artificial Sequence
  Description of Artificial Sequence: Synthetic polypeptide
IAYFEMDVQVGETFKVPSSCPIVTVDGYVDLSGGDRFCLG

SEQ ID NO: 1682 - protein, 40 aa, Artificial Sequence
  Description of Artificial Sequence: Synthetic polypeptide
VQVGETFKVPSSCPIVTVDGYVDLSGGDRFCLGQLSNVHR

SEQ ID NO: 1683 - protein, 40 aa, Artificial Sequence
  Description of Artificial Sequence: Synthetic polypeptide
HPAPEYWCSIAYFEMDVQVGETFKVPSSCPIVTVDGYVDS

SEQ ID NO: 1684 - protein, 40 aa, Artificial Sequence
  Description of Artificial Sequence: Synthetic polypeptide
APEYWCSIAYFEMDVQVGETFKVPSSCPIVTVDGYVDSSG

SEQ ID NO: 1685 - protein, 40 aa, Artificial Sequence
  Description of Artificial Sequence: Synthetic polypeptide
PEYWCSIAYFEMDVQVGETFKVPSSCPIVTVDGYVDSSGG

SEQ ID NO: 1686 - protein, 40 aa, Artificial Sequence
  Description of Artificial Sequence: Synthetic polypeptide
SIAYFEMDVQVGETFKVPSSCPIVTVDGYVDSSGGDRFCL

SEQ ID NO: 1687 - protein, 40 aa, Artificial Sequence
  Description of Artificial Sequence: Synthetic polypeptide
AYFEMDVQVGETFKVPSSCPIVTVDGYVDSSGGDRFCLGQ

SEQ ID NO: 1688 - protein, 40 aa, Artificial Sequence
  Description of Artificial Sequence: Synthetic polypeptide
FEMDVQVGETFKVPSSCPIVTVDGYVDSSGGDRFCLGQLS

SEQ ID NO: 1689 - protein, 40 aa, Artificial Sequence
  Description of Artificial Sequence: Synthetic polypeptide
MDVQVGETFKVPSSCPIVTVDGYVDSSGGDRFCLGQLSNV

SEQ ID NO: 1690 - protein, 40 aa, Artificial Sequence
  Description of Artificial Sequence: Synthetic polypeptide
SCPIVTVDGYVDSSGGDRFCLGQLSNVHRTEAIERARLHI

SEQ ID NO: 1691 - protein, 40 aa, Artificial Sequence
  Description of Artificial Sequence: Synthetic polypeptide
YVDSSGGDRFCLGQLSNVHRTEAIERARLHIGKGVQLECK

SEQ ID NO: 1692 - protein, 40 aa, Artificial Sequence
  Description of Artificial Sequence: Synthetic polypeptide
CSIAYFEMDVQVGETFKVPSSCPIVTVDGYVDPSGGDCFC

SEQ ID NO: 1693 - protein, 40 aa, Artificial Sequence
  Description of Artificial Sequence: Synthetic polypeptide
FEMDVQVGETFKVPSSCPIVTVDGYVDPSGGDCFCLGQLS

SEQ ID NO: 1694 - protein, 40 aa, Artificial Sequence
  Description of Artificial Sequence: Synthetic polypeptide
MDVQVGETFKVPSSCPIVTVDGYVDPSGGDCFCLGQLSNV

SEQ ID NO: 1695 - protein, 40 aa, Artificial Sequence
  Description of Artificial Sequence: Synthetic polypeptide
DVQVGETFKVPSSCPIVTVDGYVDPSGGDCFCLGQLSNVH

SEQ ID NO: 1696 - protein, 40 aa, Artificial Sequence
  Description of Artificial Sequence: Synthetic polypeptide
QVGETFKVPSSCPIVTVDGYVDPSGGDCFCLGQLSNVHRT

SEQ ID NO: 1697 - protein, 40 aa, Artificial Sequence
  Description of Artificial Sequence: Synthetic polypeptide
ETFKVPSSCPIVTVDGYVDPSGGDCFCLGQLSNVHRTEAI

SEQ ID NO: 1698 - protein, 40 aa, Artificial Sequence
  Description of Artificial Sequence: Synthetic polypeptide
VPSSCPIVTVDGYVDPSGGDCFCLGQLSNVHRTEAIERAR

SEQ ID NO: 1699 - protein, 40 aa, Artificial Sequence
  Description of Artificial Sequence: Synthetic polypeptide
SSCPIVTVDGYVDPSGGDCFCLGQLSNVHRTEAIERARLH

SEQ ID NO: 1700 - protein, 40 aa, Artificial Sequence
  Description of Artificial Sequence: Synthetic polypeptide
IVTVDGYVDPSGGDCFCLGQLSNVHRTEAIERARLHIGKG

SEQ ID NO: 1701 - protein, 40 aa, Artificial Sequence
  Description of Artificial Sequence: Synthetic polypeptide
VTVDGYVDPSGGDCFCLGQLSNVHRTEAIERARLHIGKGV

SEQ ID NO: 1702 - protein, 40 aa, Artificial Sequence
  Description of Artificial Sequence: Synthetic polypeptide
VDGYVDPSGGDCFCLGQLSNVHRTEAIERARLHIGKGVQL

SEQ ID NO: 1703 - protein, 40 aa, Artificial Sequence
  Description of Artificial Sequence: Synthetic polypeptide
WCSIAYFEMDVQVGETFKVPSSCPIVTVDGYVDPSGGDHF

SEQ ID NO: 1704 - protein, 40 aa, Artificial Sequence
  Description of Artificial Sequence: Synthetic polypeptide
IAYFEMDVQVGETFKVPSSCPIVTVDGYVDPSGGDHFCLG

SEQ ID NO: 1705 - protein, 40 aa, Artificial Sequence
  Description of Artificial Sequence: Synthetic polypeptide
DVQVGETFKVPSSCPIVTVDGYVDPSGGDHFCLGQLSNVH

SEQ ID NO: 1706 - protein, 40 aa, Artificial Sequence
  Description of Artificial Sequence: Synthetic polypeptide
VTVDGYVDPSGGDHFCLGQLSNVHRTEAIERARLHIGKGV

SEQ ID NO: 1707 - protein, 40 aa, Artificial Sequence
  Description of Artificial Sequence: Synthetic polypeptide
SIAYFEMDVQVGETFKVPSSCPIVTVDGYVDPSGGDRFSL

SEQ ID NO: 1708 - protein, 40 aa, Artificial Sequence
  Description of Artificial Sequence: Synthetic polypeptide
DVQVGETFKVPSSCPIVTVDGYVDPSGGDRFSLGQLSNVH

SEQ ID NO: 1709 - protein, 40 aa, Artificial Sequence
  Description of Artificial Sequence: Synthetic polypeptide
QVGETFKVPSSCPIVTVDGYVDPSGGDRFSLGQLSNVHRT

SEQ ID NO: 1710 - protein, 40 aa, Artificial Sequence
  Description of Artificial Sequence: Synthetic polypeptide
SGGDRFSLGQLSNVHRTEAIERARLHIGKGVQLECKGEGD

SEQ ID NO: 1711 - protein, 40 aa, Artificial Sequence
  Description of Artificial Sequence: Synthetic polypeptide
FSLGQLSNVHRTEAIERARLHIGKGVQLECKGEGDVWVRC

SEQ ID NO: 1712 - protein, 40 aa, Artificial Sequence
  Description of Artificial Sequence: Synthetic polypeptide
IAYFEMDVQVGETFKVPSSCPIVTVDGYVDPSGGDRFCLD

SEQ ID NO: 1713 - protein, 40 aa, Artificial Sequence
  Description of Artificial Sequence: Synthetic polypeptide
EMDVQVGETFKVPSSCPIVTVDGYVDPSGGDRFCLDQLSN

SEQ ID NO: 1714 - protein, 40 aa, Artificial Sequence
  Description of Artificial Sequence: Synthetic polypeptide
MDVQVGETFKVPSSCPIVTVDGYVDPSGGDRFCLDQLSNV

SEQ ID NO: 1715 - protein, 40 aa, Artificial Sequence
  Description of Artificial Sequence: Synthetic polypeptide
VQVGETFKVPSSCPIVTVDGYVDPSGGDRFCLDQLSNVHR

SEQ ID NO: 1716 - protein, 40 aa, Artificial Sequence
  Description of Artificial Sequence: Synthetic polypeptide
QVGETFKVPSSCPIVTVDGYVDPSGGDRFCLDQLSNVHRT

SEQ ID NO: 1717 - protein, 40 aa, Artificial Sequence
  Description of Artificial Sequence: Synthetic polypeptide
PSSCPIVTVDGYVDPSGGDRFCLDQLSNVHRTEAIERARL

SEQ ID NO: 1718 - protein, 40 aa, Artificial Sequence
  Description of Artificial Sequence: Synthetic polypeptide
VDGYVDPSGGDRFCLDQLSNVHRTEAIERARLHIGKGVQL

SEQ ID NO: 1719 - protein, 40 aa, Artificial Sequence
  Description of Artificial Sequence: Synthetic polypeptide
SGGDRFCLDQLSNVHRTEAIERARLHIGKGVQLECKGEGD

SEQ ID NO: 1720 - protein, 40 aa, Artificial Sequence
  Description of Artificial Sequence: Synthetic polypeptide
GDRFCLDQLSNVHRTEAIERARLHIGKGVQLECKGEGDVW

SEQ ID NO: 1721 - protein, 40 aa, Artificial Sequence
  Description of Artificial Sequence: Synthetic polypeptide
CLDQLSNVHRTEAIERARLHIGKGVQLECKGEGDVWVRCL

SEQ ID NO: 1722 - protein, 40 aa, Artificial Sequence
  Description of Artificial Sequence: Synthetic polypeptide
AYFEMDVQVGETFKVPSSCPIVTVDGYVDPSGGDRFCLRQ

SEQ ID NO: 1723 - protein, 40 aa, Artificial Sequence
  Description of Artificial Sequence: Synthetic polypeptide
SCPIVTVDGYVDPSGGDRFCLRQLSNVHRTEAIERARLHI

SEQ ID NO: 1724 - protein, 40 aa, Artificial Sequence
  Description of Artificial Sequence: Synthetic polypeptide
FEMDVQVGETFKVPSSCPIVTVDGYVDPSGGDRFCLGKLS

SEQ ID NO: 1725 - protein, 40 aa, Artificial Sequence
  Description of Artificial Sequence: Synthetic polypeptide
EMDVQVGETFKVPSSCPIVTVDGYVDPSGGDRFCLGKLSN

SEQ ID NO: 1726 - protein, 40 aa, Artificial Sequence
  Description of Artificial Sequence: Synthetic polypeptide
DVQVGETFKVPSSCPIVTVDGYVDPSGGDRFCLGKLSNVH

SEQ ID NO: 1727 - protein, 40 aa, Artificial Sequence
  Description of Artificial Sequence: Synthetic polypeptide
VGETFKVPSSCPIVTVDGYVDPSGGDRFCLGKLSNVHRTE

SEQ ID NO: 1728 - protein, 40 aa, Artificial Sequence
  Description of Artificial Sequence: Synthetic polypeptide
TFKVPSSCPIVTVDGYVDPSGGDRFCLGKLSNVHRTEAIE

SEQ ID NO: 1729 - protein, 40 aa, Artificial Sequence
  Description of Artificial Sequence: Synthetic polypeptide
PSSCPIVTVDGYVDPSGGDRFCLGKLSNVHRTEAIERARL

SEQ ID NO: 1730 - protein, 40 aa, Artificial Sequence
  Description of Artificial Sequence: Synthetic polypeptide
VTVDGYVDPSGGDRFCLGKLSNVHRTEAIERARLHIGKGV

SEQ ID NO: 1731 - protein, 40 aa, Artificial Sequence
  Description of Artificial Sequence: Synthetic polypeptide
DPSGGDRFCLGKLSNVHRTEAIERARLHIGKGVQLECKGE

SEQ ID NO: 1732 - protein, 40 aa, Artificial Sequence
  Description of Artificial Sequence: Synthetic polypeptide
CLGKLSNVHRTEAIERARLHIGKGVQLECKGEGDVWVRCL

SEQ ID NO: 1733 - protein, 40 aa, Artificial Sequence
  Description of Artificial Sequence: Synthetic polypeptide
DVQVGETFKVPSSCPIVTVDGYVDPSGGDRFCLGQLCNVH

SEQ ID NO: 1734 - protein, 40 aa, Artificial Sequence
  Description of Artificial Sequence: Synthetic polypeptide
TFKVPSSCPIVTVDGYVDPSGGDRFCLGQLCNVHRTEAIE

SEQ ID NO: 1735 - protein, 40 aa, Artificial Sequence
  Description of Artificial Sequence: Synthetic polypeptide
TVDGYVDPSGGDRFCLGQLCNVHRTEAIERARLHIGKGVQ

SEQ ID NO: 1736 - protein, 40 aa, Artificial Sequence
  Description of Artificial Sequence: Synthetic polypeptide
VDGYVDPSGGDRFCLGQLCNVHRTEAIERARLHIGKGVQL

SEQ ID NO: 1737 - protein, 40 aa, Artificial Sequence
  Description of Artificial Sequence: Synthetic polypeptide
GYVDPSGGDRFCLGQLCNVHRTEAIERARLHIGKGVQLEC

SEQ ID NO: 1738 - protein, 40 aa, Artificial Sequence
  Description of Artificial Sequence: Synthetic polypeptide
YVDPSGGDRFCLGQLCNVHRTEAIERARLHIGKGVQLECK

SEQ ID NO: 1739 - protein, 40 aa, Artificial Sequence
  Description of Artificial Sequence: Synthetic polypeptide
RFCLGQLCNVHRTEAIERARLHIGKGVQLECKGEGDVWVR

SEQ ID NO: 1740 - protein, 40 aa, Artificial Sequence
  Description of Artificial Sequence: Synthetic polypeptide
DGYVDPSGGDRFCLGQLSNVHRTEAIERARLDIGKGVQLE

SEQ ID NO: 1741 - protein, 40 aa, Artificial Sequence
  Description of Artificial Sequence: Synthetic polypeptide
GYVDPSGGDRFCLGQLSNVHRTEAIERARLDIGKGVQLEC

SEQ ID NO: 1742 - protein, 40 aa, Artificial Sequence
  Description of Artificial Sequence: Synthetic polypeptide
YVDPSGGDRFCLGQLSNVHRTEAIERARLDIGKGVQLECK

SEQ ID NO: 1743 - protein, 40 aa, Artificial Sequence
  Description of Artificial Sequence: Synthetic polypeptide
DPSGGDRFCLGQLSNVHRTEAIERARLDIGKGVQLECKGE

SEQ ID NO: 1744 - protein, 40 aa, Artificial Sequence
  Description of Artificial Sequence: Synthetic polypeptide
CLGQLSNVHRTEAIERARLDIGKGVQLECKGEGDVWVRCL

SEQ ID NO: 1745 - protein, 40 aa, Artificial Sequence
  Description of Artificial Sequence: Synthetic polypeptide
AIERARLDIGKGVQLECKGEGDVWVRCLSDHAVFVQSYYL

SEQ ID NO: 1746 - protein, 40 aa, Artificial Sequence
  Description of Artificial Sequence: Synthetic polypeptide
RLDIGKGVQLECKGEGDVWVRCLSDHAVFVQSYYLDREAG

SEQ ID NO: 1747 - protein, 40 aa, Artificial Sequence
  Description of Artificial Sequence: Synthetic polypeptide
IVTVDGYVDPSGGDRFCLGQLSNVHRTEAIERARLHRGKG

SEQ ID NO: 1748 - protein, 40 aa, Artificial Sequence
  Description of Artificial Sequence: Synthetic polypeptide
DRFCLGQLSNVHRTEAIERARLHRGKGVQLECKGEGDVWV

SEQ ID NO: 1749 - protein, 40 aa, Artificial Sequence
  Description of Artificial Sequence: Synthetic polypeptide
SNVHRTEAIERARLHRGKGVQLECKGEGDVWVRCLSDHAV

SEQ ID NO: 1750 - protein, 40 aa, Artificial Sequence
  Description of Artificial Sequence: Synthetic polypeptide
HRTEAIERARLHRGKGVQLECKGEGDVWVRCLSDHAVFVQ

SEQ ID NO: 1751 - protein, 40 aa, Artificial Sequence
  Description of Artificial Sequence: Synthetic polypeptide
ERARLHRGKGVQLECKGEGDVWVRCLSDHAVFVQSYYLDR

SEQ ID NO: 1752 - protein, 40 aa, Artificial Sequence
  Description of Artificial Sequence: Synthetic polypeptide
LHRGKGVQLECKGEGDVWVRCLSDHAVFVQSYYLDREAGR

SEQ ID NO: 1753 - protein, 40 aa, Artificial Sequence
  Description of Artificial Sequence: Synthetic polypeptide
TVDGYVDPSGGDRFCLGQLSNVHRTEAIERARLHIDKGVQ

SEQ ID NO: 1754 - protein, 40 aa, Artificial Sequence
  Description of Artificial Sequence: Synthetic polypeptide
LSNVHRTEAIERARLHIDKGVQLECKGEGDVWVRCLSDHA

SEQ ID NO: 1755 - protein, 40 aa, Artificial Sequence
  Description of Artificial Sequence: Synthetic polypeptide
TEAIERARLHIDKGVQLECKGEGDVWVRCLSDHAVFVQSY

SEQ ID NO: 1756 - protein, 40 aa, Artificial Sequence
  Description of Artificial Sequence: Synthetic polypeptide
ERARLHIDKGVQLECKGEGDVWVRCLSDHAVFVQSYYLDR

SEQ ID NO: 1757 - protein, 40 aa, Artificial Sequence
  Description of Artificial Sequence: Synthetic polypeptide
RLHIDKGVQLECKGEGDVWVRCLSDHAVFVQSYYLDREAG

SEQ ID NO: 1758 - protein, 40 aa, Artificial Sequence
  Description of Artificial Sequence: Synthetic polypeptide
IDKGVQLECKGEGDVWVRCLSDHAVFVQSYYLDREAGRAP

SEQ ID NO: 1759 - protein, 40 aa, Artificial Sequence
  Description of Artificial Sequence: Synthetic polypeptide
DKGVQLECKGEGDVWVRCLSDHAVFVQSYYLDREAGRAPG

SEQ ID NO: 1760 - protein, 40 aa, Artificial Sequence
  Description of Artificial Sequence: Synthetic polypeptide
YVDPSGGDRFCLGQLSNVHRTEAIERARLHIGKSVQLECK

SEQ ID NO: 1761 - protein, 40 aa, Artificial Sequence
  Description of Artificial Sequence: Synthetic polypeptide
GGDRFCLGQLSNVHRTEAIERARLHIGKSVQLECKGEGDV

SEQ ID NO: 1762 - protein, 40 aa, Artificial Sequence
  Description of Artificial Sequence: Synthetic polypeptide
RFCLGQLSNVHRTEAIERARLHIGKSVQLECKGEGDVWVR

SEQ ID NO: 1763 - protein, 40 aa, Artificial Sequence
  Description of Artificial Sequence: Synthetic polypeptide
QLSNVHRTEAIERARLHIGKSVQLECKGEGDVWVRCLSDH

SEQ ID NO: 1764 - protein, 40 aa, Artificial Sequence
  Description of Artificial Sequence: Synthetic polypeptide
TEAIERARLHIGKSVQLECKGEGDVWVRCLSDHAVFVQSY

SEQ ID NO: 1765 - protein, 40 aa, Artificial Sequence
  Description of Artificial Sequence: Synthetic polypeptide
HIGKSVQLECKGEGDVWVRCLSDHAVFVQSYYLDREAGRA

SEQ ID NO: 1766 - protein, 40 aa, Artificial Sequence
  Description of Artificial Sequence: Synthetic polypeptide
VDGYVDPSGGDRFCLGQLSNVHRTEAIERARLHIGKVVQL

SEQ ID NO: 1767 - protein, 40 aa, Artificial Sequence
  Description of Artificial Sequence: Synthetic polypeptide
GYVDPSGGDRFCLGQLSNVHRTEAIERARLHIGKVVQLEC

SEQ ID NO: 1768 - protein, 40 aa, Artificial Sequence
  Description of Artificial Sequence: Synthetic polypeptide
LGQLSNVHRTEAIERARLHIGKVVQLECKGEGDVWVRCLS

SEQ ID NO: 1769 - protein, 40 aa, Artificial Sequence
  Description of Artificial Sequence: Synthetic polypeptide
GQLSNVHRTEAIERARLHIGKVVQLECKGEGDVWVRCLSD

SEQ ID NO: 1770 - protein, 40 aa, Artificial Sequence
  Description of Artificial Sequence: Synthetic polypeptide
NVHRTEAIERARLHIGKVVQLECKGEGDVWVRCLSDHAVF

SEQ ID NO: 1771 - protein, 40 aa, Artificial Sequence
  Description of Artificial Sequence: Synthetic polypeptide
ERARLHIGKVVQLECKGEGDVWVRCLSDHAVFVQSYYLDR

SEQ ID NO: 1772 - protein, 40 aa, Artificial Sequence
  Description of Artificial Sequence: Synthetic polypeptide
ARLHIGKVVQLECKGEGDVWVRCLSDHAVFVQSYYLDREA

SEQ ID NO: 1773 - protein, 40 aa, Artificial Sequence
  Description of Artificial Sequence: Synthetic polypeptide
IGKVVQLECKGEGDVWVRCLSDHAVFVQSYYLDREAGRAP

SEQ ID NO: 1774 - protein, 40 aa, Artificial Sequence
  Description of Artificial Sequence: Synthetic polypeptide
NVHRTEAIERARLHIGKGVQLECKGEGDVWVRCLSDHVVF

SEQ ID NO: 1775 - protein, 40 aa, Artificial Sequence
  Description of Artificial Sequence: Synthetic polypeptide
VHRTEAIERARLHIGKGVQLECKGEGDVWVRCLSDHVVFV

SEQ ID NO: 1776 - protein, 40 aa, Artificial Sequence
  Description of Artificial Sequence: Synthetic polypeptide
TEAIERARLHIGKGVQLECKGEGDVWVRCLSDHVVFVQSY

SEQ ID NO: 1777 - protein, 40 aa, Artificial Sequence
  Description of Artificial Sequence: Synthetic polypeptide
IERARLHIGKGVQLECKGEGDVWVRCLSDHVVFVQSYYLD

SEQ ID NO: 1778 - protein, 40 aa, Artificial Sequence
  Description of Artificial Sequence: Synthetic polypeptide
ERARLHIGKGVQLECKGEGDVWVRCLSDHVVFVQSYYLDR

SEQ ID NO: 1779 - protein, 40 aa, Artificial Sequence
  Description of Artificial Sequence: Synthetic polypeptide
LHIGKGVQLECKGEGDVWVRCLSDHVVFVQSYYLDREAGR

SEQ ID NO: 1780 - protein, 40 aa, Artificial Sequence
  Description of Artificial Sequence: Synthetic polypeptide
GDVWVRCLSDHVVFVQSYYLDREAGRAPGDAVHKIYPSAY

SEQ ID NO: 1781 - protein, 40 aa, Artificial Sequence
  Description of Artificial Sequence: Synthetic polypeptide
HVVFVQSYYLDREAGRAPGDAVHKIYPSAYIKVFDLRQCH

SEQ ID NO: 1782 - protein, 40 aa, Artificial Sequence
  Description of Artificial Sequence: Synthetic polypeptide
RARLHIGKGVQLECKGEGDVWVRCLSDHAVLVQSYYLDRE

SEQ ID NO: 1783 - protein, 40 aa, Artificial Sequence
  Description of Artificial Sequence: Synthetic polypeptide
LHIGKGVQLECKGEGDVWVRCLSDHAVLVQSYYLDREAGR

SEQ ID NO: 1784 - protein, 40 aa, Artificial Sequence
  Description of Artificial Sequence: Synthetic polypeptide
LSDHAVLVQSYYLDREAGRAPGDAVHKIYPSAYIKVFDLR

SEQ ID NO: 1785 - protein, 40 aa, Artificial Sequence
  Description of Artificial Sequence: Synthetic polypeptide
VAGNIPGPGSVGGIAPAISLSAAAGIGVDDLRRLCILRMR

SEQ ID NO: 1786 - protein, 40 aa, Artificial Sequence
  Description of Artificial Sequence: Synthetic polypeptide
GNIPGPGSVGGIAPAISLSAAAGIGVDDLRRLCILRMRFV

SEQ ID NO: 1787 - protein, 40 aa, Artificial Sequence
  Description of Artificial Sequence: Synthetic polypeptide
AAAGIGVDDLRRLCILRMRFVKGWGPDYPRQSIKETPCWI

SEQ ID NO: 1788 - protein, 40 aa, Artificial Sequence
  Description of Artificial Sequence: Synthetic polypeptide
IPGPGSVGGIAPAISLSAAAGIGVDDLRRLCILRMSFVNG

SEQ ID NO: 1789 - protein, 40 aa, Artificial Sequence
  Description of Artificial Sequence: Synthetic polypeptide
VGGIAPAISLSAAAGIGVDDLRRLCILRMSFVNGWGPDYP

SEQ ID NO: 1790 - protein, 40 aa, Artificial Sequence
  Description of Artificial Sequence: Synthetic polypeptide
GGIAPAISLSAAAGIGVDDLRRLCILRMSFVNGWGPDYPR

SEQ ID NO: 1791 - protein, 40 aa, Artificial Sequence
  Description of Artificial Sequence: Synthetic polypeptide
GIAPAISLSAAAGIGVDDLRRLCILRMSFVKGGGPDYPRQ

SEQ ID NO: 1792 - protein, 40 aa, Artificial Sequence
  Description of Artificial Sequence: Synthetic polypeptide
LSAAAGIGVDDLRRLCILRMSFVKGWGPDYPRQSIKETPW

SEQ ID NO: 1793 - protein, 40 aa, Artificial Sequence
  Description of Artificial Sequence: Synthetic polypeptide
IGVDDLRRLCILRMSFVKGWGPDYPRQSIKETPCLIEIHL

SEQ ID NO: 1794 - protein, 40 aa, Artificial Sequence
  Description of Artificial Sequence: Synthetic polypeptide
YPRQSIKETPCLIEIHLHRALQLLDEVLHTMPIADPQPLD

SEQ ID NO: 1795 - protein, 40 aa, Artificial Sequence
  Description of Artificial Sequence: Synthetic polypeptide
SAAAGIGVDDLRRLCILRMSFVKGWGPDYPRQSIKETPCR

SEQ ID NO: 1796 - protein, 40 aa, Artificial Sequence
  Description of Artificial Sequence: Synthetic polypeptide
GEETKAMESQRAYRFVQGKDGGFKKFIRRDFLLDEANGLL

SEQ ID NO: 1797 - protein, 40 aa, Artificial Sequence
  Description of Artificial Sequence: Synthetic polypeptide
YRFVQGKDGGFKKFIRRDFLLDEANGLLPDDKLTLFCEVS

SEQ ID NO: 1798 - protein, 40 aa, Artificial Sequence
  Description of Artificial Sequence: Synthetic polypeptide
RFVQGKDGGFKKFIRRDFLLDEANGLLPDDKLTLFCEVSV

SEQ ID NO: 1799 - protein, 40 aa, Artificial Sequence
  Description of Artificial Sequence: Synthetic polypeptide
QGKDGGFKKFIRRDFLLDEANGLLPDDKLTLFCEVSVVQD

SEQ ID NO: 1800 - protein, 40 aa, Artificial Sequence
  Description of Artificial Sequence: Synthetic polypeptide
KSSTFSSGANDKLKWCLRVNPKGLDEESKDYLSLNLLLVS

SEQ ID NO: 1801 - protein, 40 aa, Artificial Sequence
  Description of Artificial Sequence: Synthetic polypeptide
SSTFSSGANDKLKWCLRVNPKGLDEESKDYLSLNLLLVSC

SEQ ID NO: 1802 - protein, 40 aa, Artificial Sequence
  Description of Artificial Sequence: Synthetic polypeptide
SSGANDKLKWCLRVNPKGLDEESKDYLSLNLLLVSCPKSE

SEQ ID NO: 1803 - protein, 40 aa, Artificial Sequence
  Description of Artificial Sequence: Synthetic polypeptide
SGANDKLKWCLRVNPKGLDEESKDYLSLNLLLVSCPKSEV

SEQ ID NO: 1804 - protein, 40 aa, Artificial Sequence
  Description of Artificial Sequence: Synthetic polypeptide
EESKDYLSLNLLLVSCPKSEVRAKFKFSILNAKGEETKAM

SEQ ID NO: 1805 - protein, 40 aa, Artificial Sequence
  Description of Artificial Sequence: Synthetic polypeptide
DPEARLTAQCVAERFSELEHLDRLSGRSCHEEKIPEDGSL

SEQ ID NO: 1806 - protein, 40 aa, Artificial Sequence
  Description of Artificial Sequence: Synthetic polypeptide
PAPAAPTPAAPAPAPSWPLSSSVPSQKTYQCSYGFRLGFL

SEQ ID NO: 1807 - protein, 40 aa, Artificial Sequence
  Description of Artificial Sequence: Synthetic polypeptide
AAPTPAAPAPAPSWPLSSSVPSQKTYQCSYGFRLGFLHSG

SEQ ID NO: 1808 - protein, 40 aa, Artificial Sequence
  Description of Artificial Sequence: Synthetic polypeptide
PAPAPSWPLSSSVPSQKTYQCSYGFRLGFLHSGTAKSVTC

SEQ ID NO: 1809 - protein, 40 aa, Artificial Sequence
  Description of Artificial Sequence: Synthetic polypeptide
APAPSWPLSSSVPSQKTYQCSYGFRLGFLHSGTAKSVTCT

SEQ ID NO: 1810 - protein, 40 aa, Artificial Sequence
  Description of Artificial Sequence: Synthetic polypeptide
APSWPLSSSVPSQKTYQCSYGFRLGFLHSGTAKSVTCTYS

SEQ ID NO: 1811 - protein, 40 aa, Artificial Sequence
  Description of Artificial Sequence: Synthetic polypeptide
EAAPPVAPAPAAPTPAAPAPAPSWPLSSSVPSQKTYQVSY

SEQ ID NO: 1812 - protein, 40 aa, Artificial Sequence
  Description of Artificial Sequence: Synthetic polypeptide
VAPAPAAPTPAAPAPAPSWPLSSSVPSQKTYQVSYGFRLG

SEQ ID NO: 1813 - protein, 40 aa, Artificial Sequence
  Description of Artificial Sequence: Synthetic polypeptide
APAPAAPTPAAPAPAPSWPLSSSVPSQKTYQVSYGFRLGF

SEQ ID NO: 1814 - protein, 40 aa, Artificial Sequence
  Description of Artificial Sequence: Synthetic polypeptide
PAPAAPTPAAPAPAPSWPLSSSVPSQKTYQVSYGFRLGFL

SEQ ID NO: 1815 - protein, 40 aa, Artificial Sequence
  Description of Artificial Sequence: Synthetic polypeptide
APAAPTPAAPAPAPSWPLSSSVPSQKTYQVSYGFRLGFLH

SEQ ID NO: 1816 - protein, 40 aa, Artificial Sequence
  Description of Artificial Sequence: Synthetic polypeptide
PTPAAPAPAPSWPLSSSVPSQKTYQVSYGFRLGFLHSGTA

SEQ ID NO: 1817 - protein, 40 aa, Artificial Sequence
  Description of Artificial Sequence: Synthetic polypeptide
AAPPVAPAPAAPTPAAPAPAPSWPLSSSVPSQKTYQGSDG

SEQ ID NO: 1818 - protein, 40 aa, Artificial Sequence
  Description of Artificial Sequence: Synthetic polypeptide
PAAPTPAAPAPAPSWPLSSSVPSQKTYQGSDGFRLGFLHS

SEQ ID NO: 1819 - protein, 40 aa, Artificial Sequence
  Description of Artificial Sequence: Synthetic polypeptide
APAPAAPTPAAPAPAPSWPLSSSVPSQKTYQGSYGSRLGF

SEQ ID NO: 1820 - protein, 40 aa, Artificial Sequence
  Description of Artificial Sequence: Synthetic polypeptide
APPVAPAPAAPTPAAPAPAPSWPLSSSVPSQKTYQGSYGV

SEQ ID NO: 1821 - protein, 40 aa, Artificial Sequence
  Description of Artificial Sequence: Synthetic polypeptide
APAPAAPTPAAPAPAPSWPLSSSVPSQKTYQGSYGVRLGF

SEQ ID NO: 1822 - protein, 40 aa, Artificial Sequence
  Description of Artificial Sequence: Synthetic polypeptide
PSWPLSSSVPSQKTYQGSYGFPLGFLHSGTAKSVTCTYSP

SEQ ID NO: 1823 - protein, 40 aa, Artificial Sequence
  Description of Artificial Sequence: Synthetic polypeptide
PLSSSVPSQKTYQGSYGFPLGFLHSGTAKSVTCTYSPALN

SEQ ID NO: 1824 - protein, 40 aa, Artificial Sequence
  Description of Artificial Sequence: Synthetic polypeptide
VPSQKTYQGSYGFPLGFLHSGTAKSVTCTYSPALNKMFCQ

SEQ ID NO: 1825 - protein, 40 aa, Artificial Sequence
  Description of Artificial Sequence: Synthetic polypeptide
RLGVLHSGTAKSVTCTYSPALNKMFCQLAKTCPVQLWVDS

SEQ ID NO: 1826 - protein, 40 aa, Artificial Sequence
  Description of Artificial Sequence: Synthetic polypeptide
AAPAPAPSWPLSSSVPSQKTYQGSYGFRLGFLHSGTAESV

SEQ ID NO: 1827 - protein, 40 aa, Artificial Sequence
  Description of Artificial Sequence: Synthetic polypeptide
LHSGTAKSVTCPYSPALNKMFCQLAKTCPVQLWVDSTPPP

SEQ ID NO: 1828 - protein, 40 aa, Artificial Sequence
  Description of Artificial Sequence: Synthetic polypeptide
SQKTYQGSYGFRLGFLHSGTAKSVTCTDSPALNKMFCQLA

SEQ ID NO: 1829 - protein, 40 aa, Artificial Sequence
  Description of Artificial Sequence: Synthetic polypeptide
GFLHSGTAKSVTCTYPPALNKMFCQLAKTCPVQLWVDSTP

SEQ ID NO: 1830 - protein, 40 aa, Artificial Sequence
  Description of Artificial Sequence: Synthetic polypeptide
YQGSYGFRLGFLHSGTAKSVTCTYSPALNEMFCQLAKTCP

SEQ ID NO: 1831 - protein, 40 aa, Artificial Sequence
  Description of Artificial Sequence: Synthetic polypeptide
LNEMFCQLAKTCPVQLWVDSTPPPGTRVRAMAIYKQSQHM

SEQ ID NO: 1832 - protein, 40 aa, Artificial Sequence
  Description of Artificial Sequence: Synthetic polypeptide
QGSYGFRLGFLHSGTAKSVTCTYSPALNNMFCQLAKTCPV

SEQ ID NO: 1833 - protein, 40 aa, Artificial Sequence
  Description of Artificial Sequence: Synthetic polypeptide
GFRLGFLHSGTAKSVTCTYSPALNNMFCQLAKTCPVQLWV

SEQ ID NO: 1834 - protein, 40 aa, Artificial Sequence
  Description of Artificial Sequence: Synthetic polypeptide
LGFLHSGTAKSVTCTYSPALNNMFCQLAKTCPVQLWVDST

SEQ ID NO: 1835 - protein, 40 aa, Artificial Sequence
  Description of Artificial Sequence: Synthetic polypeptide
ALNNMFCQLAKTCPVQLWVDSTPPPGTRVRAMAIYKQSQH

SEQ ID NO: 1836 - protein, 40 aa, Artificial Sequence
  Description of Artificial Sequence: Synthetic polypeptide
RLGFLHSGTAKSVTCTYSPALNKMLCQLAKTCPVQLWVDS

SEQ ID NO: 1837 - protein, 40 aa, Artificial Sequence
  Description of Artificial Sequence: Synthetic polypeptide
SYGFRLGFLHSGTAKSVTCTYSPALNKMFCELAKTCPVQL

SEQ ID NO: 1838 - protein, 40 aa, Artificial Sequence
  Description of Artificial Sequence: Synthetic polypeptide
LHSGTAKSVTCTYSPALNKMFCELAKTCPVQLWVDSTPPP

SEQ ID NO: 1839 - protein, 40 aa, Artificial Sequence
  Description of Artificial Sequence: Synthetic polypeptide
KSVTCTYSPALNKMFCELAKTCPVQLWVDSTPPPGTRVRA

SEQ ID NO: 1840 - protein, 40 aa, Artificial Sequence
  Description of Artificial Sequence: Synthetic polypeptide
ALNKMFCELAKTCPVQLWVDSTPPPGTRVRAMAIYKQSQH

SEQ ID NO: 1841 - protein, 40 aa, Artificial Sequence
  Description of Artificial Sequence: Synthetic polypeptide
CELAKTCPVQLWVDSTPPPGTRVRAMAIYKQSQHMTEVVR

SEQ ID NO: 1842 - protein, 40 aa, Artificial Sequence
  Description of Artificial Sequence: Synthetic polypeptide
KMFCQQAKTCPVQLWVDSTPPPGTRVRAMAIYKQSQHMTE

SEQ ID NO: 1843 - protein, 40 aa, Artificial Sequence
  Description of Artificial Sequence: Synthetic polypeptide
CQLTKTCPVQLWVDSTPPPGTRVRAMAIYKQSQHMTEVVR

SEQ ID NO: 1844 - protein, 40 aa, Artificial Sequence
  Description of Artificial Sequence: Synthetic polypeptide
GFLHSGTAKSVTCTYSPALNKMFCQLVKTCPVQLWVDSTP

SEQ ID NO: 1845 - protein, 40 aa, Artificial Sequence
  Description of Artificial Sequence: Synthetic polypeptide
CQLVKTCPVQLWVDSTPPPGTRVRAMAIYKQSQHMTEVVR

SEQ ID NO: 1846 - protein, 40 aa, Artificial Sequence
  Description of Artificial Sequence: Synthetic polypeptide
MFCQLAKTYPVQLWVDSTPPPGTRVRAMAIYKQSQHMTEV

SEQ ID NO: 1847 - protein, 40 aa, Artificial Sequence
  Description of Artificial Sequence: Synthetic polypeptide
CQLAKTCLVQLWVDSTPPPGTRVRAMAIYKQSQHMTEVVR

SEQ ID NO: 1848 - protein, 40 aa, Artificial Sequence
  Description of Artificial Sequence: Synthetic polypeptide
LGFLHSGTAKSVTCTYSPALNKMFCQLAKTCPAQLWVDST

SEQ ID NO: 1849 - protein, 40 aa, Artificial Sequence
  Description of Artificial Sequence: Synthetic polypeptide
CQLAKTCPAQLWVDSTPPPGTRVRAMAIYKQSQHMTEVVR

SEQ ID NO: 1850 - protein, 40 aa, Artificial Sequence
  Description of Artificial Sequence: Synthetic polypeptide
CPVHLWVDSTPPPGTRVRAMAIYKQSQHMTEVVRRCPHHE

SEQ ID NO: 1851 - protein, 40 aa, Artificial Sequence
  Description of Artificial Sequence: Synthetic polypeptide
GTAKSVTCTYSPALNKMFCQLAKTCPVQPWVDSTPPPGTR

SEQ ID NO: 1852 - protein, 40 aa, Artificial Sequence
  Description of Artificial Sequence: Synthetic polypeptide
KMFCQLAKTCPVQPWVDSTPPPGTRVRAMAIYKQSQHMTE

SEQ ID NO: 1853 - protein, 40 aa, Artificial Sequence
  Description of Artificial Sequence: Synthetic polypeptide
MFCQLAKTCPVQPWVDSTPPPGTRVRAMAIYKQSQHMTEV

SEQ ID NO: 1854 - protein, 40 aa, Artificial Sequence
  Description of Artificial Sequence: Synthetic polypeptide
FRLGFLHSGTAKSVTCTYSPALNKMFCQLAKTCPVQLWGD

SEQ ID NO: 1855 - protein, 40 aa, Artificial Sequence
  Description of Artificial Sequence: Synthetic polypeptide
LWGDSTPPPGTRVRAMAIYKQSQHMTEVVRRCPHHERCSD

SEQ ID NO: 1856 - protein, 40 aa, Artificial Sequence
  Description of Artificial Sequence: Synthetic polypeptide
CQLAKTCPVQLWVDSTSPPGTRVRAMAIYKQSQHMTEVVR

SEQ ID NO: 1857 - protein, 40 aa, Artificial Sequence
  Description of Artificial Sequence: Synthetic polypeptide
CPVQLWVDSTSPPGTRVRAMAIYKQSQHMTEVVRRCPHHE

SEQ ID NO: 1858 - protein, 40 aa, Artificial Sequence
  Description of Artificial Sequence: Synthetic polypeptide
LWVDSTPLPGTRVRAMAIYKQSQHMTEVVRRCPHHERCSD

SEQ ID NO: 1859 - protein, 40 aa, Artificial Sequence
  Description of Artificial Sequence: Synthetic polypeptide
PSPGTRVRAMAIYKQSQHMTEVVRRCPHHERCSDSDGLAP

SEQ ID NO: 1860 - protein, 40 aa, Artificial Sequence
  Description of Artificial Sequence: Synthetic polypeptide
WVDSTPPPVTRVRAMAIYKQSQHMTEVVRRCPHHERCSDS

SEQ ID NO: 1861 - protein, 40 aa, Artificial Sequence
  Description of Artificial Sequence: Synthetic polypeptide
PPPVTRVRAMAIYKQSQHMTEVVRRCPHHERCSDSDGLAP

SEQ ID NO: 1862 - protein, 40 aa, Artificial Sequence
  Description of Artificial Sequence: Synthetic polypeptide
WVDSTPPPGPRVRAMAIYKQSQHMTEVVRRCPHHERCSDS

SEQ ID NO: 1863 - protein, 40 aa, Artificial Sequence
  Description of Artificial Sequence: Synthetic polypeptide
PGPRVRAMAIYKQSQHMTEVVRRCPHHERCSDSDGLAPPQ

SEQ ID NO: 1864 - protein, 40 aa, Artificial Sequence
  Description of Artificial Sequence: Synthetic polypeptide
PRVRAMAIYKQSQHMTEVVRRCPHHERCSDSDGLAPPQHL

SEQ ID NO: 1865 - protein, 40 aa, Artificial Sequence
  Description of Artificial Sequence: Synthetic polypeptide
PGTPVRAMAIYKQSQHMTEVVRRCPHHERCSDSDGLAPPQ

SEQ ID NO: 1866 - protein, 40 aa, Artificial Sequence
  Description of Artificial Sequence: Synthetic polypeptide
ALNKMFCQLAKTCPVQLWVDSTPPPGTRDRAMAIYKQSQH

SEQ ID NO: 1867 - protein, 40 aa, Artificial Sequence
  Description of Artificial Sequence: Synthetic polypeptide
DSTPPPGTRVHAMAIYKQSQHMTEVVRRCPHHERCSDSDG

SEQ ID NO: 1868 - protein, 40 aa, Artificial Sequence
  Description of Artificial Sequence: Synthetic polypeptide
QLWVDSTPPPGTRVSAMAIYKQSQHMTEVVRRCPHHERCS

SEQ ID NO: 1869 - protein, 40 aa, Artificial Sequence
  Description of Artificial Sequence: Synthetic polypeptide
DSTPPPGTRVSAMAIYKQSQHMTEVVRRCPHHERCSDSDG

SEQ ID NO: 1870 - protein, 40 aa, Artificial Sequence
  Description of Artificial Sequence: Synthetic polypeptide
SAMAIYKQSQHMTEVVRRCPHHERCSDSDGLAPPQHLIRV

SEQ ID NO: 1871 - protein, 40 aa, Artificial Sequence
  Description of Artificial Sequence: Synthetic polypeptide
CQLAKTCPVQLWVDSTPPPGTRVRPMAIYKQSQHMTEVVR

SEQ ID NO: 1872 - protein, 40 aa, Artificial Sequence
  Description of Artificial Sequence: Synthetic polypeptide
CPVQLWVDSTPPPGTRVRPMAIYKQSQHMTEVVRRCPHHE

SEQ ID NO: 1873 - protein, 40 aa, Artificial Sequence
  Description of Artificial Sequence: Synthetic polypeptide
VQLWVDSTPPPGTRVRAMDIYKQSQHMTEVVRRCPHHERC

SEQ ID NO: 1874 - protein, 40 aa, Artificial Sequence
  Description of Artificial Sequence: Synthetic polypeptide
GTRVRAMTIYKQSQHMTEVVRRCPHHERCSDSDGLAPPQH

SEQ ID NO: 1875 - protein, 40 aa, Artificial Sequence
  Description of Artificial Sequence: Synthetic polypeptide
KMFCQLAKTCPVQLWVDSTPPPGTRVRAMAFYKQSQHMTE

SEQ ID NO: 1876 - protein, 40 aa, Artificial Sequence
  Description of Artificial Sequence: Synthetic polypeptide
CQLAKTCPVQLWVDSTPPPGTRVRAMAFYKQSQHMTEVVR

SEQ ID NO: 1877 - protein, 40 aa, Artificial Sequence
  Description of Artificial Sequence: Synthetic polypeptide
RVRAMAFYKQSQHMTEVVRRCPHHERCSDSDGLAPPQHLI

SEQ ID NO: 1878 - protein, 40 aa, Artificial Sequence
  Description of Artificial Sequence: Synthetic polypeptide
STPPPGTRVRAMAICKQSQHMTEVVRRCPHHERCSDSDGL

SEQ ID NO: 1879 - protein, 40 aa, Artificial Sequence
  Description of Artificial Sequence: Synthetic polypeptide
GTRVRAMAIHKQSQHMTEVVRRCPHHERCSDSDGLAPPQH

SEQ ID NO: 1880 - protein, 40 aa, Artificial Sequence
  Description of Artificial Sequence: Synthetic polypeptide
VRAMAIHKQSQHMTEVVRRCPHHERCSDSDGLAPPQHLIR

SEQ ID NO: 1881 - protein, 40 aa, Artificial Sequence
  Description of Artificial Sequence: Synthetic polypeptide
AIHKQSQHMTEVVRRCPHHERCSDSDGLAPPQHLIRVEGN

SEQ ID NO: 1882 - protein, 40 aa, Artificial Sequence
  Description of Artificial Sequence: Synthetic polypeptide
NKMFCQLAKTCPVQLWVDSTPPPGTRVRAMAIYEQSQHMT

SEQ ID NO: 1883 - protein, 40 aa, Artificial Sequence
  Description of Artificial Sequence: Synthetic polypeptide
KMFCQLAKTCPVQLWVDSTPPPGTRVRAMAIYEQSQHMTE

SEQ ID NO: 1884 - protein, 40 aa, Artificial Sequence
  Description of Artificial Sequence: Synthetic polypeptide
WVDSTPPPGTRVRAMAIYEQSQHMTEVVRRCPHHERCSDS

SEQ ID NO: 1885 - protein, 40 aa, Artificial Sequence
  Description of Artificial Sequence: Synthetic polypeptide
GTRVRAMAIYEQSQHMTEVVRRCPHHERCSDSDGLAPPQH

SEQ ID NO: 1886 - protein, 40 aa, Artificial Sequence
  Description of Artificial Sequence: Synthetic polypeptide
STPPPGTRVRAMAIYKQSQHMTEDVRRCPHHERCSDSDGL

SEQ ID NO: 1887 - protein, 40 aa, Artificial Sequence
  Description of Artificial Sequence: Synthetic polypeptide
DSTPPPGTRVRAMAIYKQSQHMTEVGRRCPHHERCSDSDG

SEQ ID NO: 1888 - protein, 40 aa, Artificial Sequence
  Description of Artificial Sequence: Synthetic polypeptide
VRAMAIYKQSQHMTEVGRRCPHHERCSDSDGLAPPQHLIR

SEQ ID NO: 1889 - protein, 40 aa, Artificial Sequence
  Description of Artificial Sequence: Synthetic polypeptide
RAMAIYKQSQHMTEVGRRCPHHERCSDSDGLAPPQHLIRV

SEQ ID NO: 1890 - protein, 40 aa, Artificial Sequence
  Description of Artificial Sequence: Synthetic polypeptide
AMAIYKQSQHMTEVGRRCPHHERCSDSDGLAPPQHLIRVE

SEQ ID NO: 1891 - protein, 40 aa, Artificial Sequence
  Description of Artificial Sequence: Synthetic polypeptide
QHMTEVGRRCPHHERCSDSDGLAPPQHLIRVEGNLRVEYL

SEQ ID NO: 1892 - protein, 40 aa, Artificial Sequence
  Description of Artificial Sequence: Synthetic polypeptide
TEVGRRCPHHERCSDSDGLAPPQHLIRVEGNLRVEYLDDR

SEQ ID NO: 1893 - protein, 40 aa, Artificial Sequence
  Description of Artificial Sequence: Synthetic polypeptide
GTRVRAMAIYKQSQHMTEVLRRCPHHERCSDSDGLAPPQH

SEQ ID NO: 1894 - protein, 40 aa, Artificial Sequence
  Description of Artificial Sequence: Synthetic polypeptide
WRCPHHERCSDSDGLAPPQHLIRVEGNLRVEYLDDRNTFR

SEQ ID NO: 1895 - protein, 40 aa, Artificial Sequence
  Description of Artificial Sequence: Synthetic polypeptide
AKTCPVQLWVDSTPPPGTRVRAMAIYKQSQHMTEVVRGCP

SEQ ID NO: 1896 - protein, 40 aa, Artificial Sequence
  Description of Artificial Sequence: Synthetic polypeptide
PGTRVRAMAIYKQSQHMTEVVRGCPHHERCSDSDGLAPPQ

SEQ ID NO: 1897 - protein, 40 aa, Artificial Sequence
  Description of Artificial Sequence: Synthetic polypeptide
RGCPHHERCSDSDGLAPPQHLIRVEGNLRVEYLDDRNTFR

SEQ ID NO: 1898 - protein, 40 aa, Artificial Sequence
  Description of Artificial Sequence: Synthetic polypeptide
AIYKQSQHMTEVVRHCPHHERCSDSDGLAPPQHLIRVEGN

SEQ ID NO: 1899 - protein, 40 aa, Artificial Sequence
  Description of Artificial Sequence: Synthetic polypeptide
RAMAIYKQSQHMTEVVRRFPHHERCSDSDGLAPPQHLIRV

SEQ ID NO: 1900 - protein, 40 aa, Artificial Sequence
  Description of Artificial Sequence: Synthetic polypeptide
VVRRFPHHERCSDSDGLAPPQHLIRVEGNLRVEYLDDRNT

SEQ ID NO: 1901 - protein, 40 aa, Artificial Sequence
  Description of Artificial Sequence: Synthetic polypeptide
RFPHHERCSDSDGLAPPQHLIRVEGNLRVEYLDDRNTFRH

SEQ ID NO: 1902 - protein, 40 aa, Artificial Sequence
  Description of Artificial Sequence: Synthetic polypeptide
IYKQSQHMTEVVRRRPHHERCSDSDGLAPPQHLIRVEGNL

SEQ ID NO: 1903 - protein, 40 aa, Artificial Sequence
  Description of Artificial Sequence: Synthetic polypeptide
QHMTEVVRRRPHHERCSDSDGLAPPQHLIRVEGNLRVEYL

SEQ ID NO: 1904 - protein, 40 aa, Artificial Sequence
  Description of Artificial Sequence: Synthetic polypeptide
TEVVRRRPHHERCSDSDGLAPPQHLIRVEGNLRVEYLDDR

SEQ ID NO: 1905 - protein, 40 aa, Artificial Sequence
  Description of Artificial Sequence: Synthetic polypeptide
MTEVVRRCRHHERCSDSDGLAPPQHLIRVEGNLRVEYLDD

SEQ ID NO: 1906 - protein, 40 aa, Artificial Sequence
  Description of Artificial Sequence: Synthetic polypeptide
CPVQLWVDSTPPPGTRVRAMAIYKQSQHMTEVVRRCSHHE

SEQ ID NO: 1907 - protein, 40 aa, Artificial Sequence
  Description of Artificial Sequence: Synthetic polypeptide
VRRCSHHERCSDSDGLAPPQHLIRVEGNLRVEYLDDRNTF

SEQ ID NO: 1908 - protein, 40 aa, Artificial Sequence
  Description of Artificial Sequence: Synthetic polypeptide
RCSHHERCSDSDGLAPPQHLIRVEGNLRVEYLDDRNTFRH

SEQ ID NO: 1909 - protein, 40 aa, Artificial Sequence
  Description of Artificial Sequence: Synthetic polypeptide
RCPQHERCSDSDGLAPPQHLIRVEGNLRVEYLDDRNTFRH

SEQ ID NO: 1910 - protein, 40 aa, Artificial Sequence
  Description of Artificial Sequence: Synthetic polypeptide
STPPPGTRVRAMAIYKQSQHMTEVVRRCPHDERCSDSDGL

SEQ ID NO: 1911 - protein, 40 aa, Artificial Sequence
  Description of Artificial Sequence: Synthetic polypeptide
VRAMAIYKQSQHMTEVVRRCPHDERCSDSDGLAPPQHLIR

SEQ ID NO: 1912 - protein, 40 aa, Artificial Sequence
  Description of Artificial Sequence: Synthetic polypeptide
QHMTEVVRRCPHDERCSDSDGLAPPQHLIRVEGNLRVEYL

SEQ ID NO: 1913 - protein, 40 aa, Artificial Sequence
  Description of Artificial Sequence: Synthetic polypeptide
EVVRRCPHDERCSDSDGLAPPQHLIRVEGNLRVEYLDDRN

SEQ ID NO: 1914 - protein, 40 aa, Artificial Sequence
  Description of Artificial Sequence: Synthetic polypeptide
RCPHDERCSDSDGLAPPQHLIRVEGNLRVEYLDDRNTFRH

SEQ ID NO: 1915 - protein, 40 aa, Artificial Sequence
  Description of Artificial Sequence: Synthetic polypeptide
CPHDERCSDSDGLAPPQHLIRVEGNLRVEYLDDRNTFRHS

SEQ ID NO: 1916 - protein, 40 aa, Artificial Sequence
  Description of Artificial Sequence: Synthetic polypeptide
LWVDSTPPPGTRVRAMAIYKQSQHMTEVVRRCPHQERCSD

SEQ ID NO: 1917 - protein, 40 aa, Artificial Sequence
  Description of Artificial Sequence: Synthetic polypeptide
VDSTPPPGTRVRAMAIYKQSQHMTEVVRRCPHQERCSDSD

SEQ ID NO: 1918 - protein, 40 aa, Artificial Sequence
  Description of Artificial Sequence: Synthetic polypeptide
DSTPPPGTRVRAMAIYKQSQHMTEVVRRCPHQERCSDSDG

SEQ ID NO: 1919 - protein, 40 aa, Artificial Sequence
  Description of Artificial Sequence: Synthetic polypeptide
RVRAMAIYKQSQHMTEVVRRCPHQERCSDSDGLAPPQHLI

SEQ ID NO: 1920 - protein, 40 aa, Artificial Sequence
  Description of Artificial Sequence: Synthetic polypeptide
CPHRERCSDSDGLAPPQHLIRVEGNLRVEYLDDRNTFRHS

SEQ ID NO: 1921 - protein, 40 aa, Artificial Sequence
  Description of Artificial Sequence: Synthetic polypeptide
HRERCSDSDGLAPPQHLIRVEGNLRVEYLDDRNTFRHSVV

SEQ ID NO: 1922 - protein, 40 aa, Artificial Sequence
  Description of Artificial Sequence: Synthetic polypeptide
AIYKQSQHMTEVVRRCPHHKRCSDSDGLAPPQHLIRVEGN

SEQ ID NO: 1923 - protein, 40 aa, Artificial Sequence
  Description of Artificial Sequence: Synthetic polypeptide
SQHMTEVVRRCPHHKRCSDSDGLAPPQHLIRVEGNLRVEY

SEQ ID NO: 1924 - protein, 40 aa, Artificial Sequence
  Description of Artificial Sequence: Synthetic polypeptide
DSTPPPGTRVRAMAIYKQSQHMTEVVRRCPHHECCSDSDG

SEQ ID NO: 1925 - protein, 40 aa, Artificial Sequence
  Description of Artificial Sequence: Synthetic polypeptide
PPPGTRVRAMAIYKQSQHMTEVVRRCPHHECCSDSDGLAP

SEQ ID NO: 1926 - protein, 40 aa, Artificial Sequence
  Description of Artificial Sequence: Synthetic polypeptide
QHMTEVVRRCPHHECCSDSDGLAPPQHLIRVEGNLRVEYL

SEQ ID NO: 1927 - protein, 40 aa, Artificial Sequence
  Description of Artificial Sequence: Synthetic polypeptide
VDSTPPPGTRVRAMAIYKQSQHMTEVVRRCPHHEHCSDSD

SEQ ID NO: 1928 - protein, 40 aa, Artificial Sequence
  Description of Artificial Sequence: Synthetic polypeptide
AMAIYKQSQHMTEVVRRCPHHEHCSDSDGLAPPQHLIRVE

SEQ ID NO: 1929 - protein, 40 aa, Artificial Sequence
  Description of Artificial Sequence: Synthetic polypeptide
VRRCPHHEHCSDSDGLAPPQHLIRVEGNLRVEYLDDRNTF

SEQ ID NO: 1930 - protein, 40 aa, Artificial Sequence
  Description of Artificial Sequence: Synthetic polypeptide
RRCPHHEHCSDSDGLAPPQHLIRVEGNLRVEYLDDRNTFR

SEQ ID NO: 1931 - protein, 40 aa, Artificial Sequence
  Description of Artificial Sequence: Synthetic polypeptide
PHHEHCSDSDGLAPPQHLIRVEGNLRVEYLDDRNTFRHSV

SEQ ID NO: 1932 - protein, 40 aa, Artificial Sequence
  Description of Artificial Sequence: Synthetic polypeptide
VVRRCPHHERCSDSDGLALPQHLIRVEGNLRVEYLDDRNT

SEQ ID NO: 1933 - protein, 40 aa, Artificial Sequence
  Description of Artificial Sequence: Synthetic polypeptide
VRRCPHHERCSDSDGLALPQHLIRVEGNLRVEYLDDRNTF

SEQ ID NO: 1934 - protein, 40 aa, Artificial Sequence
  Description of Artificial Sequence: Synthetic polypeptide
HERCSDSDGLALPQHLIRVEGNLRVEYLDDRNTFRHSVVV

SEQ ID NO: 1935 - protein, 40 aa, Artificial Sequence
  Description of Artificial Sequence: Synthetic polypeptide
RCSDSDGLALPQHLIRVEGNLRVEYLDDRNTFRHSVVVPY

SEQ ID NO: 1936 - protein, 40 aa, Artificial Sequence
  Description of Artificial Sequence: Synthetic polypeptide
SQHMTEVVRRCPHHERCSDSDGLAPPRHLIRVEGNLRVEY

SEQ ID NO: 1937 - protein, 40 aa, Artificial Sequence
  Description of Artificial Sequence: Synthetic polypeptide
EVVRRCPHHERCSDSDGLAPPQNLIRVEGNLRVEYLDDRN

SEQ ID NO: 1938 - protein, 40 aa, Artificial Sequence
  Description of Artificial Sequence: Synthetic polypeptide
ERCSDSDGLAPPQNLIRVEGNLRVEYLDDRNTFRHSVVVP

SEQ ID NO: 1939 - protein, 40 aa, Artificial Sequence
  Description of Artificial Sequence: Synthetic polypeptide
SDSDGLAPPQNLIRVEGNLRVEYLDDRNTFRHSVVVPYEP

SEQ ID NO: 1940 - protein, 40 aa, Artificial Sequence
  Description of Artificial Sequence: Synthetic polypeptide
AMAIYKQSQHMTEVVRRCPHHERCSDSDGLAPPQRLIRVE

SEQ ID NO: 1941 - protein, 40 aa, Artificial Sequence
  Description of Artificial Sequence: Synthetic polypeptide
VVRRCPHHERCSDSDGLAPPQRLIRVEGNLRVEYLDDRNT

SEQ ID NO: 1942 - protein, 40 aa, Artificial Sequence
  Description of Artificial Sequence: Synthetic polypeptide
HMTEVVRRCPHHERCSDSDGLAPPQHFIRVEGNLRVEYLD

SEQ ID NO: 1943 - protein, 40 aa, Artificial Sequence
  Description of Artificial Sequence: Synthetic polypeptide
HERCSDSDGLAPPQHFIRVEGNLRVEYLDDRNTFRHSVVV

SEQ ID NO: 1944 - protein, 40 aa, Artificial Sequence
  Description of Artificial Sequence: Synthetic polypeptide
QHFIRVEGNLRVEYLDDRNTFRHSVVVPYEPPEVGSDCTT

SEQ ID NO: 1945 - protein, 40 aa, Artificial Sequence
  Description of Artificial Sequence: Synthetic polypeptide
AIYKQSQHMTEVVRRCPHHERCSDSDGLAPPQHHIRVEGN

SEQ ID NO: 1946 - protein, 40 aa, Artificial Sequence
  Description of Artificial Sequence: Synthetic polypeptide
HMTEVVRRCPHHERCSDSDGLAPPQHHIRVEGNLRVEYLD

SEQ ID NO: 1947 - protein, 40 aa, Artificial Sequence
  Description of Artificial Sequence: Synthetic polypeptide
CPHHERCSDSDGLAPPQHHIRVEGNLRVEYLDDRNTFRHS

SEQ ID NO: 1948 - protein, 40 aa, Artificial Sequence
  Description of Artificial Sequence: Synthetic polypeptide
ERCSDSDGLAPPQHHIRVEGNLRVEYLDDRNTFRHSVVVP

SEQ ID NO: 1949 - protein, 40 aa, Artificial Sequence
  Description of Artificial Sequence: Synthetic polypeptide
MTEVVRRCPHHERCSDSDGLAPPQHLFRVEGNLRVEYLDD

SEQ ID NO: 1950 - protein, 40 aa, Artificial Sequence
  Description of Artificial Sequence: Synthetic polypeptide
EVVRRCPHHERCSDSDGLAPPQHLFRVEGNLRVEYLDDRN

SEQ ID NO: 1951 - protein, 40 aa, Artificial Sequence
  Description of Artificial Sequence: Synthetic polypeptide
VRRCPHHERCSDSDGLAPPQHLFRVEGNLRVEYLDDRNTF

SEQ ID NO: 1952 - protein, 40 aa, Artificial Sequence
  Description of Artificial Sequence: Synthetic polypeptide
HHERCSDSDGLAPPQHLFRVEGNLRVEYLDDRNTFRHSVV

SEQ ID NO: 1953 - protein, 40 aa, Artificial Sequence
  Description of Artificial Sequence: Synthetic polypeptide
RCSDSDGLAPPQHLFRVEGNLRVEYLDDRNTFRHSVVVPY

SEQ ID NO: 1954 - protein, 40 aa, Artificial Sequence
  Description of Artificial Sequence: Synthetic polypeptide
CSDSDGLAPPQHLFRVEGNLRVEYLDDRNTFRHSVVVPYE

SEQ ID NO: 1955 - protein, 40 aa, Artificial Sequence
  Description of Artificial Sequence: Synthetic polypeptide
APPQHLFRVEGNLRVEYLDDRNTFRHSVVVPYEPPEVGSD

SEQ ID NO: 1956 - protein, 40 aa, Artificial Sequence
  Description of Artificial Sequence: Synthetic polypeptide
RVRAMAIYKQSQHMTEVVRRCPHHERCSDSDGLAPPQHLM

SEQ ID NO: 1957 - protein, 40 aa, Artificial Sequence
  Description of Artificial Sequence: Synthetic polypeptide
AMAIYKQSQHMTEVVRRCPHHERCSDSDGLAPPQHLMRVE

SEQ ID NO: 1958 - protein, 40 aa, Artificial Sequence
  Description of Artificial Sequence: Synthetic polypeptide
AIYKQSQHMTEVVRRCPHHERCSDSDGLAPPQHLMRVEGN

SEQ ID NO: 1959 - protein, 40 aa, Artificial Sequence
  Description of Artificial Sequence: Synthetic polypeptide
VRRCPHHERCSDSDGLAPPQHLMRVEGNLRVEYLDDRNTF

SEQ ID NO: 1960 - protein, 40 aa, Artificial Sequence
  Description of Artificial Sequence: Synthetic polypeptide
CSDSDGLAPPQHLMRVEGNLRVEYLDDRNTFRHSVVVPYE

SEQ ID NO: 1961 - protein, 40 aa, Artificial Sequence
  Description of Artificial Sequence: Synthetic polypeptide
RVRAMAIYKQSQHMTEVVRRCPHHERCSDSDGLAPPQHLN

SEQ ID NO: 1962 - protein, 40 aa, Artificial Sequence
  Description of Artificial Sequence: Synthetic polypeptide
VRAMAIYKQSQHMTEVVRRCPHHERCSDSDGLAPPQHLNR

SEQ ID NO: 1963 - protein, 40 aa, Artificial Sequence
  Description of Artificial Sequence: Synthetic polypeptide
YKQSQHMTEVVRRCPHHERCSDSDGLAPPQHLNRVEGNLR

SEQ ID NO: 1964 - protein, 40 aa, Artificial Sequence
  Description of Artificial Sequence: Synthetic polypeptide
QHMTEVVRRCPHHERCSDSDGLAPPQHLNRVEGNLRVEYL

SEQ ID NO: 1965 - protein, 40 aa, Artificial Sequence
  Description of Artificial Sequence: Synthetic polypeptide
RCSDSDGLAPPQHLNRVEGNLRVEYLDDRNTFRHSVVVPY

SEQ ID NO: 1966 - protein, 40 aa, Artificial Sequence
  Description of Artificial Sequence: Synthetic polypeptide
CSDSDGLAPPQHLNRVEGNLRVEYLDDRNTFRHSVVVPYE

SEQ ID NO: 1967 - protein, 40 aa, Artificial Sequence
  Description of Artificial Sequence: Synthetic polypeptide
RAMAIYKQSQHMTEVVRRCPHHERCSDSDGLAPPQHLIPV

SEQ ID NO: 1968 - protein, 40 aa, Artificial Sequence
  Description of Artificial Sequence: Synthetic polypeptide
SQHMTEVVRRCPHHERCSDSDGLAPPQHLIPVEGNLRVEY

SEQ ID NO: 1969 - protein, 40 aa, Artificial Sequence
  Description of Artificial Sequence: Synthetic polypeptide
RCPHHERCSDSDGLAPPQHLIPVEGNLRVEYLDDRNTFRH

SEQ ID NO: 1970 - protein, 40 aa, Artificial Sequence
  Description of Artificial Sequence: Synthetic polypeptide
CPHHERCSDSDGLAPPQHLIPVEGNLRVEYLDDRNTFRHS

SEQ ID NO: 1971 - protein, 40 aa, Artificial Sequence
  Description of Artificial Sequence: Synthetic polypeptide
PHHERCSDSDGLAPPQHLIPVEGNLRVEYLDDRNTFRHSV

SEQ ID NO: 1972 - protein, 40 aa, Artificial Sequence
  Description of Artificial Sequence: Synthetic polypeptide
HERCSDSDGLAPPQHLIPVEGNLRVEYLDDRNTFRHSVVV

SEQ ID NO: 1973 - protein, 40 aa, Artificial Sequence
  Description of Artificial Sequence: Synthetic polypeptide
LAPPQHLIPVEGNLRVEYLDDRNTFRHSVVVPYEPPEVGS

SEQ ID NO: 1974 - protein, 40 aa, Artificial Sequence
  Description of Artificial Sequence: Synthetic polypeptide
PVEGNLRVEYLDDRNTFRHSVVVPYEPPEVGSDCTTIHYN

SEQ ID NO: 1975 - protein, 40 aa, Artificial Sequence
  Description of Artificial Sequence: Synthetic polypeptide
TEVVRRCPHHERCSDSDGLAPPQHLIRGEGNLRVEYLDDR

SEQ ID NO: 1976 - protein, 40 aa, Artificial Sequence
  Description of Artificial Sequence: Synthetic polypeptide
EVVRRCPHHERCSDSDGLAPPQHLIRGEGNLRVEYLDDRN

SEQ ID NO: 1977 - protein, 40 aa, Artificial Sequence
  Description of Artificial Sequence: Synthetic polypeptide
HERCSDSDGLAPPQHLIRGEGNLRVEYLDDRNTFRHSVVV

SEQ ID NO: 1978 - protein, 40 aa, Artificial Sequence
  Description of Artificial Sequence: Synthetic polypeptide
LAPPQHLIRGEGNLRVEYLDDRNTFRHSVVVPYEPPEVGS

SEQ ID NO: 1979 - protein, 40 aa, Artificial Sequence
  Description of Artificial Sequence: Synthetic polypeptide
TEVVRRCPHHERCSDSDGLAPPQHLIRLEGNLRVEYLDDR

SEQ ID NO: 1980 - protein, 40 aa, Artificial Sequence
  Description of Artificial Sequence: Synthetic polypeptide
VVRRCPHHERCSDSDGLAPPQHLIRLEGNLRVEYLDDRNT

SEQ ID NO: 1981 - protein, 40 aa, Artificial Sequence
  Description of Artificial Sequence: Synthetic polypeptide
HERCSDSDGLAPPQHLIRVEGNLRVENLDDRNTFRHSVVV

SEQ ID NO: 1982 - protein, 40 aa, Artificial Sequence
  Description of Artificial Sequence: Synthetic polypeptide
PHHERCSDSDGLAPPQHLIRVEGNLRVESLDDRNTFRHSV

SEQ ID NO: 1983 - protein, 40 aa, Artificial Sequence
  Description of Artificial Sequence: Synthetic polypeptide
IRVEGNLRVESLDDRNTFRHSVVVPYEPPEVGSDCTTIHY

SEQ ID NO: 1984 - protein, 40 aa, Artificial Sequence
  Description of Artificial Sequence: Synthetic polypeptide
RVESLDDRNTFRHSVVVPYEPPEVGSDCTTIHYNYMCNSS

SEQ ID NO: 1985 - protein, 40 aa, Artificial Sequence
  Description of Artificial Sequence: Synthetic polypeptide
VRRCPHHERCSDSDGLAPPQHLIRVEGNLRVEYLDGRNTF

SEQ ID NO: 1986 - protein, 40 aa, Artificial Sequence
  Description of Artificial Sequence: Synthetic polypeptide
CPHHERCSDSDGLAPPQHLIRVEGNLRVEYLDGRNTFRHS

SEQ ID NO: 1987 - protein, 40 aa, Artificial Sequence
  Description of Artificial Sequence: Synthetic polypeptide
RVEYLDGRNTFRHSVVVPYEPPEVGSDCTTIHYNYMCNSS

SEQ ID NO: 1988 - protein, 40 aa, Artificial Sequence
  Description of Artificial Sequence: Synthetic polypeptide
PHHERCSDSDGLAPPQHLIRVEGNLRVEYLDDRNIFRHSV

SEQ ID NO: 1989 - protein, 40 aa, Artificial Sequence
  Description of Artificial Sequence: Synthetic polypeptide
RCSDSDGLAPPQHLIRVEGNLRVEYLDDRNIFRHSVVVPY

SEQ ID NO: 1990 - protein, 40 aa, Artificial Sequence
  Description of Artificial Sequence: Synthetic polypeptide
PQHLIRVEGNLRVEYLDDRNIFRHSVVVPYEPPEVGSDCT

SEQ ID NO: 1991 - protein, 40 aa, Artificial Sequence
  Description of Artificial Sequence: Synthetic polypeptide
IRVEGNLRVEYLDDRNIFRHSVVVPYEPPEVGSDCTTIHY

SEQ ID NO: 1992 - protein, 40 aa, Artificial Sequence
  Description of Artificial Sequence: Synthetic polypeptide
VEYLDDRNIFRHSVVVPYEPPEVGSDCTTIHYNYMCNSSC

SEQ ID NO: 1993 - protein, 40 aa, Artificial Sequence
  Description of Artificial Sequence: Synthetic polypeptide
DRNIFRHSVVVPYEPPEVGSDCTTIHYNYMCNSSCMGGMN

SEQ ID NO: 1994 - protein, 40 aa, Artificial Sequence
  Description of Artificial Sequence: Synthetic polypeptide
HHERCSDSDGLAPPQHLIRVEGNLRVEYLDDRNTFLHSVV

SEQ ID NO: 1995 - protein, 40 aa, Artificial Sequence
  Description of Artificial Sequence: Synthetic polypeptide
CSDSDGLAPPQHLIRVEGNLRVEYLDDRNTFLHSVVVPYE

SEQ ID NO: 1996 - protein, 40 aa, Artificial Sequence
  Description of Artificial Sequence: Synthetic polypeptide
HLIRVEGNLRVEYLDDRNTFLHSVVVPYEPPEVGSDCTTI

SEQ ID NO: 1997 - protein, 40 aa, Artificial Sequence
  Description of Artificial Sequence: Synthetic polypeptide
LIRVEGNLRVEYLDDRNTFLHSVVVPYEPPEVGSDCTTIH

SEQ ID NO: 1998 - protein, 40 aa, Artificial Sequence
  Description of Artificial Sequence: Synthetic polypeptide
LRVEYLDDRNTFLHSVVVPYEPPEVGSDCTTIHYNYMCNS

SEQ ID NO: 1999 - protein, 40 aa, Artificial Sequence
  Description of Artificial Sequence: Synthetic polypeptide
NTFLHSVVVPYEPPEVGSDCTTIHYNYMCNSSCMGGMNRR

SEQ ID NO: 2000 - protein, 40 aa, Artificial Sequence
  Description of Artificial Sequence: Synthetic polypeptide
IRVEGNLRVEYLDDRNTFRRSVVVPYEPPEVGSDCTTIHY

SEQ ID NO: 2001 - protein, 40 aa, Artificial Sequence
  Description of Artificial Sequence: Synthetic polypeptide
EGNLRVEYLDDRNTFRRSVVVPYEPPEVGSDCTTIHYNYM

SEQ ID NO: 2002 - protein, 40 aa, Artificial Sequence
  Description of Artificial Sequence: Synthetic polypeptide
RVEYLDDRNTFRRSVVVPYEPPEVGSDCTTIHYNYMCNSS

SEQ ID NO: 2003 - protein, 40 aa, Artificial Sequence
  Description of Artificial Sequence: Synthetic polypeptide
HERCSDSDGLAPPQHLIRVEGNLRVEYLDDRNTFRHGVVV

SEQ ID NO: 2004 - protein, 40 aa, Artificial Sequence
  Description of Artificial Sequence: Synthetic polypeptide
GLAPPQHLIRVEGNLRVEYLDDRNTFRHGVVVPYEPPEVG

SEQ ID NO: 2005 - protein, 40 aa, Artificial Sequence
  Description of Artificial Sequence: Synthetic polypeptide
APPQHLIRVEGNLRVEYLDDRNTFRHGVVVPYEPPEVGSD

SEQ ID NO: 2006 - protein, 40 aa, Artificial Sequence
  Description of Artificial Sequence: Synthetic polypeptide
IRVEGNLRVEYLDDRNTFRHGVVVPYEPPEVGSDCTTIHY

SEQ ID NO: 2007 - protein, 40 aa, Artificial Sequence
  Description of Artificial Sequence: Synthetic polypeptide
RHGVVVPYEPPEVGSDCTTIHYNYMCNSSCMGGMNRRPIL

SEQ ID NO: 2008 - protein, 40 aa, Artificial Sequence
  Description of Artificial Sequence: Synthetic polypeptide
LIRVEGNLRVEYLDDRNTFRHIVVVPYEPPEVGSDCTTIH

SEQ ID NO: 2009 - protein, 40 aa, Artificial Sequence
  Description of Artificial Sequence: Synthetic polypeptide
YLDDRNTFRHIVVVPYEPPEVGSDCTTIHYNYMCNSSCMG

SEQ ID NO: 2010 - protein, 40 aa, Artificial Sequence
  Description of Artificial Sequence: Synthetic polypeptide
CPHHERCSDSDGLAPPQHLIRVEGNLRVEYLDDRNTFRHR

SEQ ID NO: 2011 - protein, 40 aa, Artificial Sequence
  Description of Artificial Sequence: Synthetic polypeptide
LAPPQHLIRVEGNLRVEYLDDRNTFRHRVVVPYEPPEVGS

SEQ ID NO: 2012 - protein, 40 aa, Artificial Sequence
  Description of Artificial Sequence: Synthetic polypeptide
PPQHLIRVEGNLRVEYLDDRNTFRHRVVVPYEPPEVGSDC

SEQ ID NO: 2013 - protein, 40 aa, Artificial Sequence
  Description of Artificial Sequence: Synthetic polypeptide
HERCSDSDGLAPPQHLIRVEGNLRVEYLDDRNTFRHSEVV

SEQ ID NO: 2014 - protein, 40 aa, Artificial Sequence
  Description of Artificial Sequence: Synthetic polypeptide
RCSDSDGLAPPQHLIRVEGNLRVEYLDDRNTFRHSEVVPY

SEQ ID NO: 2015 - protein, 40 aa, Artificial Sequence
  Description of Artificial Sequence: Synthetic polypeptide
IRVEGNLRVEYLDDRNTFRHSEVVPYEPPEVGSDCTTIHY

SEQ ID NO: 2016 - protein, 40 aa, Artificial Sequence
  Description of Artificial Sequence: Synthetic polypeptide
RVEYLDDRNTFRHSEVVPYEPPEVGSDCTTIHYNYMCNSS

SEQ ID NO: 2017 - protein, 40 aa, Artificial Sequence
  Description of Artificial Sequence: Synthetic polypeptide
TFRHSEVVPYEPPEVGSDCTTIHYNYMCNSSCMGGMNRRP

SEQ ID NO: 2018 - protein, 40 aa, Artificial Sequence
  Description of Artificial Sequence: Synthetic polypeptide
SEVVPYEPPEVGSDCTTIHYNYMCNSSCMGGMNRRPILTI

SEQ ID NO: 2019 - protein, 40 aa, Artificial Sequence
  Description of Artificial Sequence: Synthetic polypeptide
EGNLRVEYLDDRNTFRHSLVVPYEPPEVGSDCTTIHYNYM

SEQ ID NO: 2020 - protein, 40 aa, Artificial Sequence
  Description of Artificial Sequence: Synthetic polypeptide
EYLDDRNTFRHSLVVPYEPPEVGSDCTTIHYNYMCNSSCM

SEQ ID NO: 2021 - protein, 40 aa, Artificial Sequence
  Description of Artificial Sequence: Synthetic polypeptide
RNTFRHSLVVPYEPPEVGSDCTTIHYNYMCNSSCMGGMNR

SEQ ID NO: 2022 - protein, 40 aa, Artificial Sequence
  Description of Artificial Sequence: Synthetic polypeptide
NTFRHSLVVPYEPPEVGSDCTTIHYNYMCNSSCMGGMNRR

SEQ ID NO: 2023 - protein, 40 aa, Artificial Sequence
  Description of Artificial Sequence: Synthetic polypeptide
GNLRVEYLDDRNTFRHSVVEPYEPPEVGSDCTTIHYNYMC

SEQ ID NO: 2024 - protein, 40 aa, Artificial Sequence
  Description of Artificial Sequence: Synthetic polypeptide
SDSDGLAPPQHLIRVEGNLRVEYLDDRNTFRHSVVVPCEP

SEQ ID NO: 2025 - protein, 40 aa, Artificial Sequence
  Description of Artificial Sequence: Synthetic polypeptide
PQHLIRVEGNLRVEYLDDRNTFRHSVVVPCEPPEVGSDCT

SEQ ID NO: 2026 - protein, 40 aa, Artificial Sequence
  Description of Artificial Sequence: Synthetic polypeptide
NLRVEYLDDRNTFRHSVVVPCEPPEVGSDCTTIHYNYMCN

SEQ ID NO: 2027 - protein, 40 aa, Artificial Sequence
  Description of Artificial Sequence: Synthetic polypeptide
NTFRHSVVVPCEPPEVGSDCTTIHYNYMCNSSCMGGMNRR

SEQ ID NO: 2028 - protein, 40 aa, Artificial Sequence
  Description of Artificial Sequence: Synthetic polypeptide
CSDSDGLAPPQHLIRVEGNLRVEYLDDRNTFRHSVVVPHE

SEQ ID NO: 2029 - protein, 40 aa, Artificial Sequence
  Description of Artificial Sequence: Synthetic polypeptide
VPHEPPEVGSDCTTIHYNYMCNSSCMGGMNRRPILTIITL

SEQ ID NO: 2030 - protein, 40 aa, Artificial Sequence
  Description of Artificial Sequence: Synthetic polypeptide
EYLDDRNTFRHSVVVPYEPPEVGSDCPTIHYNYMCNSSCM

SEQ ID NO: 2031 - protein, 40 aa, Artificial Sequence
  Description of Artificial Sequence: Synthetic polypeptide
DRNTFRHSVVVPYEPPEVGSDCPTIHYNYMCNSSCMGGMN

SEQ ID NO: 2032 - protein, 40 aa, Artificial Sequence
  Description of Artificial Sequence: Synthetic polypeptide
FRHSVVVPYEPPEVGSDCPTIHYNYMCNSSCMGGMNRRPI

SEQ ID NO: 2033 - protein, 40 aa, Artificial Sequence
  Description of Artificial Sequence: Synthetic polypeptide
FRHSVVVPYEPPEVGSDCTTSHYNYMCNSSCMGGMNRRPI

SEQ ID NO: 2034 - protein, 40 aa, Artificial Sequence
  Description of Artificial Sequence: Synthetic polypeptide
NTFRHSVVVPYEPPEVGSDCTTIHCNYMCNSSCMGGMNRR

SEQ ID NO: 2035 - protein, 40 aa, Artificial Sequence
  Description of Artificial Sequence: Synthetic polypeptide
CNYMCNSSCMGGMNRRPILTIITLEDSSGNLLGRNSFEVR

SEQ ID NO: 2036 - protein, 40 aa, Artificial Sequence
  Description of Artificial Sequence: Synthetic polypeptide
RVEGNLRVEYLDDRNTFRHSVVVPYEPPEVGSDCTTIHHN

SEQ ID NO: 2037 - protein, 40 aa, Artificial Sequence
  Description of Artificial Sequence: Synthetic polypeptide
VGSDCTTIHHNYMCNSSCMGGMNRRPILTIITLEDSSGNL

SEQ ID NO: 2038 - protein, 40 aa, Artificial Sequence
  Description of Artificial Sequence: Synthetic polypeptide
NLRVEYLDDRNTFRHSVVVPYEPPEVGSDCTTIHYNCMCN

SEQ ID NO: 2039 - protein, 40 aa, Artificial Sequence
  Description of Artificial Sequence: Synthetic polypeptide
LDDRNTFRHSVVVPYEPPEVGSDCTTIHYNCMCNSSCMGG

SEQ ID NO: 2040 - protein, 40 aa, Artificial Sequence
  Description of Artificial Sequence: Synthetic polypeptide
NTFRHSVVVPYEPPEVGSDCTTIHYNCMCNSSCMGGMNRR

SEQ ID NO: 2041 - protein, 40 aa, Artificial Sequence
  Description of Artificial Sequence: Synthetic polypeptide
VPYEPPEVGSDCTTIHYNCMCNSSCMGGMNRRPILTIITL

SEQ ID NO: 2042 - protein, 40 aa, Artificial Sequence
  Description of Artificial Sequence: Synthetic polypeptide
DCTTIHYNCMCNSSCMGGMNRRPILTIITLEDSSGNLLGR

SEQ ID NO: 2043 - protein, 40 aa, Artificial Sequence
  Description of Artificial Sequence: Synthetic polypeptide
YNCMCNSSCMGGMNRRPILTIITLEDSSGNLLGRNSFEVR

SEQ ID NO: 2044 - protein, 40 aa, Artificial Sequence
  Description of Artificial Sequence: Synthetic polypeptide
NCMCNSSCMGGMNRRPILTIITLEDSSGNLLGRNSFEVRV

SEQ ID NO: 2045 - protein, 40 aa, Artificial Sequence
  Description of Artificial Sequence: Synthetic polypeptide
SVVVPYEPPEVGSDCTTIHYNHMCNSSCMGGMNRRPILTI

SEQ ID NO: 2046 - protein, 40 aa, Artificial Sequence
  Description of Artificial Sequence: Synthetic polypeptide
VVVPYEPPEVGSDCTTIHYNHMCNSSCMGGMNRRPILTII

SEQ ID NO: 2047 - protein, 40 aa, Artificial Sequence
  Description of Artificial Sequence: Synthetic polypeptide
RVEYLDDRNTFRHSVVVPYEPPEVGSDCTTIHYNYICNSS

SEQ ID NO: 2048 - protein, 40 aa, Artificial Sequence
  Description of Artificial Sequence: Synthetic polypeptide
EPPEVGSDCTTIHYNYICNSSCMGGMNRRPILTIITLEDS

SEQ ID NO: 2049 - protein, 40 aa, Artificial Sequence
  Description of Artificial Sequence: Synthetic polypeptide
ICNSSCMGGMNRRPILTIITLEDSSGNLLGRNSFEVRVCA

SEQ ID NO: 2050 - protein, 40 aa, Artificial Sequence
  Description of Artificial Sequence: Synthetic polypeptide
VEYLDDRNTFRHSVVVPYEPPEVGSDCTTIHYNYKCNSSC

SEQ ID NO: 2051 - protein, 40 aa, Artificial Sequence
  Description of Artificial Sequence: Synthetic polypeptide
NTFRHSVVVPYEPPEVGSDCTTIHYNYKCNSSCMGGMNRR

SEQ ID NO: 2052 - protein, 40 aa, Artificial Sequence
  Description of Artificial Sequence: Synthetic polypeptide
YEPPEVGSDCTTIHYNYKCNSSCMGGMNRRPILTIITLED

SEQ ID NO: 2053 - protein, 40 aa, Artificial Sequence
  Description of Artificial Sequence: Synthetic polypeptide
EVGSDCTTIHYNYKCNSSCMGGMNRRPILTIITLEDSSGN

SEQ ID NO: 2054 - protein, 40 aa, Artificial Sequence
  Description of Artificial Sequence: Synthetic polypeptide
HYNYKCNSSCMGGMNRRPILTIITLEDSSGNLLGRNSFEV

SEQ ID NO: 2055 - protein, 40 aa, Artificial Sequence
  Description of Artificial Sequence: Synthetic polypeptide
YNYKCNSSCMGGMNRRPILTIITLEDSSGNLLGRNSFEVR

SEQ ID NO: 2056 - protein, 40 aa, Artificial Sequence
  Description of Artificial Sequence: Synthetic polypeptide
NYKCNSSCMGGMNRRPILTIITLEDSSGNLLGRNSFEVRV

SEQ ID NO: 2057 - protein, 40 aa, Artificial Sequence
  Description of Artificial Sequence: Synthetic polypeptide
KCNSSCMGGMNRRPILTIITLEDSSGNLLGRNSFEVRVCA

SEQ ID NO: 2058 - protein, 40 aa, Artificial Sequence
  Description of Artificial Sequence: Synthetic polypeptide
IHYNYVCNSSCMGGMNRRPILTIITLEDSSGNLLGRNSFE

SEQ ID NO: 2059 - protein, 40 aa, Artificial Sequence
  Description of Artificial Sequence: Synthetic polypeptide
YNYVCNSSCMGGMNRRPILTIITLEDSSGNLLGRNSFEVR

SEQ ID NO: 2060 - protein, 40 aa, Artificial Sequence
  Description of Artificial Sequence: Synthetic polypeptide
GNLRVEYLDDRNTFRHSVVVPYEPPEVGSDCTTIHYNYMR

SEQ ID NO: 2061 - protein, 40 aa, Artificial Sequence
  Description of Artificial Sequence: Synthetic polypeptide
DCTTIHYNYMRNSSCMGGMNRRPILTIITLEDSSGNLLGR

SEQ ID NO: 2062 - protein, 40 aa, Artificial Sequence
  Description of Artificial Sequence: Synthetic polypeptide
YNYMRNSSCMGGMNRRPILTIITLEDSSGNLLGRNSFEVR

SEQ ID NO: 2063 - protein, 40 aa, Artificial Sequence
  Description of Artificial Sequence: Synthetic polypeptide
MRNSSCMGGMNRRPILTIITLEDSSGNLLGRNSFEVRVCA

SEQ ID NO: 2064 - protein, 40 aa, Artificial Sequence
  Description of Artificial Sequence: Synthetic polypeptide
EYLDDRNTFRHSVVVPYEPPEVGSDCTTIHYNYMWNSSCM

SEQ ID NO: 2065 - protein, 40 aa, Artificial Sequence
  Description of Artificial Sequence: Synthetic polypeptide
HSVVVPYEPPEVGSDCTTIHYNYMWNSSCMGGMNRRPILT

SEQ ID NO: 2066 - protein, 40 aa, Artificial Sequence
  Description of Artificial Sequence: Synthetic polypeptide
TIHYNYMWNSSCMGGMNRRPILTIITLEDSSGNLLGRNSF

SEQ ID NO: 2067 - protein, 40 aa, Artificial Sequence
  Description of Artificial Sequence: Synthetic polypeptide
HYNYMWNSSCMGGMNRRPILTIITLEDSSGNLLGRNSFEV

SEQ ID NO: 2068 - protein, 40 aa, Artificial Sequence
  Description of Artificial Sequence: Synthetic polypeptide
YNYMWNSSCMGGMNRRPILTIITLEDSSGNLLGRNSFEVR

SEQ ID NO: 2069 - protein, 40 aa, Artificial Sequence
  Description of Artificial Sequence: Synthetic polypeptide
NYMWNSSCMGGMNRRPILTIITLEDSSGNLLGRNSFEVRV

SEQ ID NO: 2070 - protein, 40 aa, Artificial Sequence
  Description of Artificial Sequence: Synthetic polypeptide
YMWNSSCMGGMNRRPILTIITLEDSSGNLLGRNSFEVRVC

SEQ ID NO: 2071 - protein, 40 aa, Artificial Sequence
  Description of Artificial Sequence: Synthetic polypeptide
WNSSCMGGMNRRPILTIITLEDSSGNLLGRNSFEVRVCAC

SEQ ID NO: 2072 - protein, 40 aa, Artificial Sequence
  Description of Artificial Sequence: Synthetic polypeptide
RVEYLDDRNTFRHSVVVPYEPPEVGSDCTTIHYNYMYNSS

SEQ ID NO: 2073 - protein, 40 aa, Artificial Sequence
  Description of Artificial Sequence: Synthetic polypeptide
NYMYNSSCMGGMNRRPILTIITLEDSSGNLLGRNSFEVRV

SEQ ID NO: 2074 - protein, 40 aa, Artificial Sequence
  Description of Artificial Sequence: Synthetic polypeptide
YMYNSSCMGGMNRRPILTIITLEDSSGNLLGRNSFEVRVC

SEQ ID NO: 2075 - protein, 40 aa, Artificial Sequence
  Description of Artificial Sequence: Synthetic polypeptide
MYNSSCMGGMNRRPILTIITLEDSSGNLLGRNSFEVRVCA

SEQ ID NO: 2076 - protein, 40 aa, Artificial Sequence
  Description of Artificial Sequence: Synthetic polypeptide
PEVGSDCTTIHYNYMCDSSCMGGMNRRPILTIITLEDSSG

SEQ ID NO: 2077 - protein, 40 aa, Artificial Sequence
  Description of Artificial Sequence: Synthetic polypeptide
NYMCDSSCMGGMNRRPILTIITLEDSSGNLLGRNSFEVRV

SEQ ID NO: 2078 - protein, 40 aa, Artificial Sequence
  Description of Artificial Sequence: Synthetic polypeptide
MCDSSCMGGMNRRPILTIITLEDSSGNLLGRNSFEVRVCA

SEQ ID NO: 2079 - protein, 40 aa, Artificial Sequence
  Description of Artificial Sequence: Synthetic polypeptide
CDSSCMGGMNRRPILTIITLEDSSGNLLGRNSFEVRVCAC

SEQ ID NO: 2080 - protein, 40 aa, Artificial Sequence
  Description of Artificial Sequence: Synthetic polypeptide
YNYMCNRSCMGGMNRRPILTIITLEDSSGNLLGRNSFEVR

SEQ ID NO: 2081 - protein, 40 aa, Artificial Sequence
  Description of Artificial Sequence: Synthetic polypeptide
MCNRSCMGGMNRRPILTIITLEDSSGNLLGRNSFEVRVCA

SEQ ID NO: 2082 - protein, 40 aa, Artificial Sequence
  Description of Artificial Sequence: Synthetic polypeptide
NRSCMGGMNRRPILTIITLEDSSGNLLGRNSFEVRVCACP

SEQ ID NO: 2083 - protein, 40 aa, Artificial Sequence
  Description of Artificial Sequence: Synthetic polypeptide
EYLDDRNTFRHSVVVPYEPPEVGSDCTTIHYNYMCNSFCM

SEQ ID NO: 2084 - protein, 40 aa, Artificial Sequence
  Description of Artificial Sequence: Synthetic polypeptide
RHSVVVPYEPPEVGSDCTTIHYNYMCNSFCMGGMNRRPIL

SEQ ID NO: 2085 - protein, 40 aa, Artificial Sequence
  Description of Artificial Sequence: Synthetic polypeptide
HYNYMCNSFCMGGMNRRPILTIITLEDSSGNLLGRNSFEV

SEQ ID NO: 2086 - protein, 40 aa, Artificial Sequence
  Description of Artificial Sequence: Synthetic polypeptide
YMCNSFCMGGMNRRPILTIITLEDSSGNLLGRNSFEVRVC

SEQ ID NO: 2087 - protein, 40 aa, Artificial Sequence
  Description of Artificial Sequence: Synthetic polypeptide
MCNSFCMGGMNRRPILTIITLEDSSGNLLGRNSFEVRVCA

SEQ ID NO: 2088 - protein, 40 aa, Artificial Sequence
  Description of Artificial Sequence: Synthetic polypeptide
VEYLDDRNTFRHSVVVPYEPPEVGSDCTTIHYNYMCNSPC

SEQ ID NO: 2089 - protein, 40 aa, Artificial Sequence
  Description of Artificial Sequence: Synthetic polypeptide
RHSVVVPYEPPEVGSDCTTIHYNYMCNSPCMGGMNRRPIL

SEQ ID NO: 2090 - protein, 40 aa, Artificial Sequence
  Description of Artificial Sequence: Synthetic polypeptide
EVGSDCTTIHYNYMCNSPCMGGMNRRPILTIITLEDSSGN

SEQ ID NO: 2091 - protein, 40 aa, Artificial Sequence
  Description of Artificial Sequence: Synthetic polypeptide
TIHYNYMCNSPCMGGMNRRPILTIITLEDSSGNLLGRNSF

SEQ ID NO: 2092 - protein, 40 aa, Artificial Sequence
  Description of Artificial Sequence: Synthetic polypeptide
YNYMCNSPCMGGMNRRPILTIITLEDSSGNLLGRNSFEVR

SEQ ID NO: 2093 - protein, 40 aa, Artificial Sequence
  Description of Artificial Sequence: Synthetic polypeptide
YMCNSPCMGGMNRRPILTIITLEDSSGNLLGRNSFEVRVC

SEQ ID NO: 2094 - protein, 40 aa, Artificial Sequence
  Description of Artificial Sequence: Synthetic polypeptide
EYLDDRNTFRHSVVVPYEPPEVGSDCTTIHYNYMCNSSSM

SEQ ID NO: 2095 - protein, 40 aa, Artificial Sequence
  Description of Artificial Sequence: Synthetic polypeptide
YLDDRNTFRHSVVVPYEPPEVGSDCTTIHYNYMCNSSSMG

SEQ ID NO: 2096 - protein, 40 aa, Artificial Sequence
  Description of Artificial Sequence: Synthetic polypeptide
YEPPEVGSDCTTIHYNYMCNSSSMGGMNRRPILTIITLED

SEQ ID NO: 2097 - protein, 40 aa, Artificial Sequence
  Description of Artificial Sequence: Synthetic polypeptide
EPPEVGSDCTTIHYNYMCNSSSMGGMNRRPILTIITLEDS

SEQ ID NO: 2098 - protein, 40 aa, Artificial Sequence
  Description of Artificial Sequence: Synthetic polypeptide
PEVGSDCTTIHYNYMCNSSSMGGMNRRPILTIITLEDSSG

SEQ ID NO: 2099 - protein, 40 aa, Artificial Sequence
  Description of Artificial Sequence: Synthetic polypeptide
DCTTIHYNYMCNSSSMGGMNRRPILTIITLEDSSGNLLGR

SEQ ID NO: 2100 - protein, 40 aa, Artificial Sequence
  Description of Artificial Sequence: Synthetic polypeptide
DDRNTFRHSVVVPYEPPEVGSDCTTIHYNYMCNSSYMGGM

SEQ ID NO: 2101 - protein, 40 aa, Artificial Sequence
  Description of Artificial Sequence: Synthetic polypeptide
VPYEPPEVGSDCTTIHYNYMCNSSYMGGMNRRPILTIITL

SEQ ID NO: 2102 - protein, 40 aa, Artificial Sequence
  Description of Artificial Sequence: Synthetic polypeptide
HYNYMCNSSYMGGMNRRPILTIITLEDSSGNLLGRNSFEV

SEQ ID NO: 2103 - protein, 40 aa, Artificial Sequence
  Description of Artificial Sequence: Synthetic polypeptide
CNSSYMGGMNRRPILTIITLEDSSGNLLGRNSFEVRVCAC

SEQ ID NO: 2104 - protein, 40 aa, Artificial Sequence
  Description of Artificial Sequence: Synthetic polypeptide
SYMGGMNRRPILTIITLEDSSGNLLGRNSFEVRVCACPGR

SEQ ID NO: 2105 - protein, 40 aa, Artificial Sequence
  Description of Artificial Sequence: Synthetic polypeptide
TFRHSVVVPYEPPEVGSDCTTIHYNYMCNSSCIGGMNRRP

SEQ ID NO: 2106 - protein, 40 aa, Artificial Sequence
  Description of Artificial Sequence: Synthetic polypeptide
PYEPPEVGSDCTTIHYNYMCNSSCIGGMNRRPILTIITLE

SEQ ID NO: 2107 - protein, 40 aa, Artificial Sequence
  Description of Artificial Sequence: Synthetic polypeptide
EVGSDCTTIHYNYMCNSSCIGGMNRRPILTIITLEDSSGN

SEQ ID NO: 2108 - protein, 40 aa, Artificial Sequence
  Description of Artificial Sequence: Synthetic polypeptide
YMCNSSCIGGMNRRPILTIITLEDSSGNLLGRNSFEVRVC

SEQ ID NO: 2109 - protein, 40 aa, Artificial Sequence
  Description of Artificial Sequence: Synthetic polypeptide
CNSSCIGGMNRRPILTIITLEDSSGNLLGRNSFEVRVCAC

SEQ ID NO: 2110 - protein, 40 aa, Artificial Sequence
  Description of Artificial Sequence: Synthetic polypeptide
SSCIGGMNRRPILTIITLEDSSGNLLGRNSFEVRVCACPG

SEQ ID NO: 2111 - protein, 40 aa, Artificial Sequence
  Description of Artificial Sequence: Synthetic polypeptide
IGGMNRRPILTIITLEDSSGNLLGRNSFEVRVCACPGRDR

SEQ ID NO: 2112 - protein, 40 aa, Artificial Sequence
  Description of Artificial Sequence: Synthetic polypeptide
EVGSDCTTIHYNYMCNSSCMDGMNRRPILTIITLEDSSGN

SEQ ID NO: 2113 - protein, 40 aa, Artificial Sequence
  Description of Artificial Sequence: Synthetic polypeptide
YNYMCNSSCMDGMNRRPILTIITLEDSSGNLLGRNSFEVR

SEQ ID NO: 2114 - protein, 40 aa, Artificial Sequence
  Description of Artificial Sequence: Synthetic polypeptide
YMCNSSCMDGMNRRPILTIITLEDSSGNLLGRNSFEVRVC

SEQ ID NO: 2115 - protein, 40 aa, Artificial Sequence
  Description of Artificial Sequence: Synthetic polypeptide
CNSSCMDGMNRRPILTIITLEDSSGNLLGRNSFEVRVCAC

SEQ ID NO: 2116 - protein, 40 aa, Artificial Sequence
  Description of Artificial Sequence: Synthetic polypeptide
SSCMDGMNRRPILTIITLEDSSGNLLGRNSFEVRVCACPG

SEQ ID NO: 2117 - protein, 40 aa, Artificial Sequence
  Description of Artificial Sequence: Synthetic polypeptide
DGMNRRPILTIITLEDSSGNLLGRNSFEVRVCACPGRDRR

SEQ ID NO: 2118 - protein, 40 aa, Artificial Sequence
  Description of Artificial Sequence: Synthetic polypeptide
VGSDCTTIHYNYMCNSSCMSGMNRRPILTIITLEDSSGNL

SEQ ID NO: 2119 - protein, 40 aa, Artificial Sequence
  Description of Artificial Sequence: Synthetic polypeptide
GSDCTTIHYNYMCNSSCMSGMNRRPILTIITLEDSSGNLL

SEQ ID NO: 2120 - protein, 40 aa, Artificial Sequence
  Description of Artificial Sequence: Synthetic polypeptide
SDCTTIHYNYMCNSSCMSGMNRRPILTIITLEDSSGNLLG

SEQ ID NO: 2121 - protein, 40 aa, Artificial Sequence
  Description of Artificial Sequence: Synthetic polypeptide
YNYMCNSSCMSGMNRRPILTIITLEDSSGNLLGRNSFEVR

SEQ ID NO: 2122 - protein, 40 aa, Artificial Sequence
  Description of Artificial Sequence: Synthetic polypeptide
CNSSCMSGMNRRPILTIITLEDSSGNLLGRNSFEVRVCAC

SEQ ID NO: 2123 - protein, 40 aa, Artificial Sequence
  Description of Artificial Sequence: Synthetic polypeptide
MSGMNRRPILTIITLEDSSGNLLGRNSFEVRVCACPGRDR

SEQ ID NO: 2124 - protein, 40 aa, Artificial Sequence
  Description of Artificial Sequence: Synthetic polypeptide
SGMNRRPILTIITLEDSSGNLLGRNSFEVRVCACPGRDRR

SEQ ID NO: 2125 - protein, 40 aa, Artificial Sequence
  Description of Artificial Sequence: Synthetic polypeptide
CTTIHYNYMCNSSCMGDMNRRPILTIITLEDSSGNLLGRN

SEQ ID NO: 2126 - protein, 40 aa, Artificial Sequence
  Description of Artificial Sequence: Synthetic polypeptide
TIHYNYMCNSSCMGDMNRRPILTIITLEDSSGNLLGRNSF

SEQ ID NO: 2127 - protein, 40 aa, Artificial Sequence
  Description of Artificial Sequence: Synthetic polypeptide
YMCNSSCMGDMNRRPILTIITLEDSSGNLLGRNSFEVRVC

SEQ ID NO: 2128 - protein, 40 aa, Artificial Sequence
  Description of Artificial Sequence: Synthetic polypeptide
MCNSSCMGDMNRRPILTIITLEDSSGNLLGRNSFEVRVCA

SEQ ID NO: 2129 - protein, 40 aa, Artificial Sequence
  Description of Artificial Sequence: Synthetic polypeptide
NSSCMGDMNRRPILTIITLEDSSGNLLGRNSFEVRVCACP

SEQ ID NO: 2130 - protein, 40 aa, Artificial Sequence
  Description of Artificial Sequence: Synthetic polypeptide
CMGDMNRRPILTIITLEDSSGNLLGRNSFEVRVCACPGRD

SEQ ID NO: 2131 - protein, 40 aa, Artificial Sequence
  Description of Artificial Sequence: Synthetic polypeptide
NTFRHSVVVPYEPPEVGSDCTTIHYNYMCNSSCMGSMNRR

SEQ ID NO: 2132 - protein, 40 aa, Artificial Sequence
  Description of Artificial Sequence: Synthetic polypeptide
YEPPEVGSDCTTIHYNYMCNSSCMGSMNRRPILTIITLED

SEQ ID NO: 2133 - protein, 40 aa, Artificial Sequence
  Description of Artificial Sequence: Synthetic polypeptide
PEVGSDCTTIHYNYMCNSSCMGSMNRRPILTIITLEDSSG

SEQ ID NO: 2134 - protein, 40 aa, Artificial Sequence
  Description of Artificial Sequence: Synthetic polypeptide
EVGSDCTTIHYNYMCNSSCMGSMNRRPILTIITLEDSSGN

SEQ ID NO: 2135 - protein, 40 aa, Artificial Sequence
  Description of Artificial Sequence: Synthetic polypeptide
MCNSSCMGSMNRRPILTIITLEDSSGNLLGRNSFEVRVCA

SEQ ID NO: 2136 - protein, 40 aa, Artificial Sequence
  Description of Artificial Sequence: Synthetic polypeptide
NSSCMGSMNRRPILTIITLEDSSGNLLGRNSFEVRVCACP

SEQ ID NO: 2137 - protein, 40 aa, Artificial Sequence
  Description of Artificial Sequence: Synthetic polypeptide
MGSMNRRPILTIITLEDSSGNLLGRNSFEVRVCACPGRDR

SEQ ID NO: 2138 - protein, 40 aa, Artificial Sequence
  Description of Artificial Sequence: Synthetic polypeptide
GSMNRRPILTIITLEDSSGNLLGRNSFEVRVCACPGRDRR

SEQ ID NO: 2139 - protein, 40 aa, Artificial Sequence
  Description of Artificial Sequence: Synthetic polypeptide
FRHSVVVPYEPPEVGSDCTTIHYNYMCNSSCMGGTNRRPI

SEQ ID NO: 2140 - protein, 40 aa, Artificial Sequence
  Description of Artificial Sequence: Synthetic polypeptide
DCTTIHYNYMCNSSCMGGTNRRPILTIITLEDSSGNLLGR

SEQ ID NO: 2141 - protein, 40 aa, Artificial Sequence
  Description of Artificial Sequence: Synthetic polypeptide
CNSSCMGGTNRRPILTIITLEDSSGNLLGRNSFEVRVCAC

SEQ ID NO: 2142 - protein, 40 aa, Artificial Sequence
  Description of Artificial Sequence: Synthetic polypeptide
SCMGGTNRRPILTIITLEDSSGNLLGRNSFEVRVCACPGR

SEQ ID NO: 2143 - protein, 40 aa, Artificial Sequence
  Description of Artificial Sequence: Synthetic polypeptide
CMGGTNRRPILTIITLEDSSGNLLGRNSFEVRVCACPGRD

SEQ ID NO: 2144 - protein, 40 aa, Artificial Sequence
  Description of Artificial Sequence: Synthetic polypeptide
MGGTNRRPILTIITLEDSSGNLLGRNSFEVRVCACPGRDR

SEQ ID NO: 2145 - protein, 40 aa, Artificial Sequence
  Description of Artificial Sequence: Synthetic polypeptide
HYNYMCNSSCMGGVNRRPILTIITLEDSSGNLLGRNSFEV

SEQ ID NO: 2146 - protein, 40 aa, Artificial Sequence
  Description of Artificial Sequence: Synthetic polypeptide
YNYMCNSSCMGGVNRRPILTIITLEDSSGNLLGRNSFEVR

SEQ ID NO: 2147 - protein, 40 aa, Artificial Sequence
  Description of Artificial Sequence: Synthetic polypeptide
CNSSCMGGVNRRPILTIITLEDSSGNLLGRNSFEVRVCAC

SEQ ID NO: 2148 - protein, 40 aa, Artificial Sequence
  Description of Artificial Sequence: Synthetic polypeptide
SCMGGVNRRPILTIITLEDSSGNLLGRNSFEVRVCACPGR

SEQ ID NO: 2149 - protein, 40 aa, Artificial Sequence
  Description of Artificial Sequence: Synthetic polypeptide
GVNRRPILTIITLEDSSGNLLGRNSFEVRVCACPGRDRRT

SEQ ID NO: 2150 - protein, 40 aa, Artificial Sequence
  Description of Artificial Sequence: Synthetic polypeptide
SVVVPYEPPEVGSDCTTIHYNYMCNSSCMGGMIRRPILTI

SEQ ID NO: 2151 - protein, 40 aa, Artificial Sequence
  Description of Artificial Sequence: Synthetic polypeptide
VVVPYEPPEVGSDCTTIHYNYMCNSSCMGGMIRRPILTII

SEQ ID NO: 2152 - protein, 40 aa, Artificial Sequence
  Description of Artificial Sequence: Synthetic polypeptide
VPYEPPEVGSDCTTIHYNYMCNSSCMGGMIRRPILTIITL

SEQ ID NO: 2153 - protein, 40 aa, Artificial Sequence
  Description of Artificial Sequence: Synthetic polypeptide
MCNSSCMGGMIRRPILTIITLEDSSGNLLGRNSFEVRVCA

SEQ ID NO: 2154 - protein, 40 aa, Artificial Sequence
  Description of Artificial Sequence: Synthetic polypeptide
SSCMGGMIRRPILTIITLEDSSGNLLGRNSFEVRVCACPG

SEQ ID NO: 2155 - protein, 40 aa, Artificial Sequence
  Description of Artificial Sequence: Synthetic polypeptide
SVVVPYEPPEVGSDCTTIHYNYMCNSSCMGGMNQRPILTI

SEQ ID NO: 2156 - protein, 40 aa, Artificial Sequence
  Description of Artificial Sequence: Synthetic polypeptide
CNSSCMGGMNQRPILTIITLEDSSGNLLGRNSFEVRVCAC

SEQ ID NO: 2157 - protein, 40 aa, Artificial Sequence
  Description of Artificial Sequence: Synthetic polypeptide
CMGGMNQRPILTIITLEDSSGNLLGRNSFEVRVCACPGRD

SEQ ID NO: 2158 - protein, 40 aa, Artificial Sequence
  Description of Artificial Sequence: Synthetic polypeptide
MNQRPILTIITLEDSSGNLLGRNSFEVRVCACPGRDRRTE

SEQ ID NO: 2159 - protein, 40 aa, Artificial Sequence
  Description of Artificial Sequence: Synthetic polypeptide
HSVVVPYEPPEVGSDCTTIHYNYMCNSSCMGGMNWRPILT

SEQ ID NO: 2160 - protein, 40 aa, Artificial Sequence
  Description of Artificial Sequence: Synthetic polypeptide
GSDCTTIHYNYMCNSSCMGGMNWRPILTIITLEDSSGNLL

SEQ ID NO: 2161 - protein, 40 aa, Artificial Sequence
  Description of Artificial Sequence: Synthetic polypeptide
YMCNSSCMGGMNWRPILTIITLEDSSGNLLGRNSFEVRVC

SEQ ID NO: 2162 - protein, 40 aa, Artificial Sequence
  Description of Artificial Sequence: Synthetic polypeptide
MNWRPILTIITLEDSSGNLLGRNSFEVRVCACPGRDRRTE

SEQ ID NO: 2163 - protein, 40 aa, Artificial Sequence
  Description of Artificial Sequence: Synthetic polypeptide
NWRPILTIITLEDSSGNLLGRNSFEVRVCACPGRDRRTEE

SEQ ID NO: 2164 - protein, 40 aa, Artificial Sequence
  Description of Artificial Sequence: Synthetic polypeptide
TFRHSVVVPYEPPEVGSDCTTIHYNYMCNSSCMGGMNRGP

SEQ ID NO: 2165 - protein, 40 aa, Artificial Sequence
  Description of Artificial Sequence: Synthetic polypeptide
VGSDCTTIHYNYMCNSSCMGGMNRGPILTIITLEDSSGNL

SEQ ID NO: 2166 - protein, 40 aa, Artificial Sequence
  Description of Artificial Sequence: Synthetic polypeptide
YNYMCNSSCMGGMNRGPILTIITLEDSSGNLLGRNSFEVR

SEQ ID NO: 2167 - protein, 40 aa, Artificial Sequence
  Description of Artificial Sequence: Synthetic polypeptide
CNSSCMGGMNRGPILTIITLEDSSGNLLGRNSFEVRVCAC

SEQ ID NO: 2168 - protein, 40 aa, Artificial Sequence
  Description of Artificial Sequence: Synthetic polypeptide
NSSCMGGMNRGPILTIITLEDSSGNLLGRNSFEVRVCACP

SEQ ID NO: 2169 - protein, 40 aa, Artificial Sequence
  Description of Artificial Sequence: Synthetic polypeptide
CMGGMNRGPILTIITLEDSSGNLLGRNSFEVRVCACPGRD

SEQ ID NO: 2170 - protein, 40 aa, Artificial Sequence
  Description of Artificial Sequence: Synthetic polypeptide
RHSVVVPYEPPEVGSDCTTIHYNYMCNSSCMGGMNRMPIL

SEQ ID NO: 2171 - protein, 40 aa, Artificial Sequence
  Description of Artificial Sequence: Synthetic polypeptide
EVGSDCTTIHYNYMCNSSCMGGMNRMPILTIITLEDSSGN

SEQ ID NO: 2172 - protein, 40 aa, Artificial Sequence
  Description of Artificial Sequence: Synthetic polypeptide
SDCTTIHYNYMCNSSCMGGMNRMPILTIITLEDSSGNLLG

SEQ ID NO: 2173 - protein, 40 aa, Artificial Sequence
  Description of Artificial Sequence: Synthetic polypeptide
DCTTIHYNYMCNSSCMGGMNRMPILTIITLEDSSGNLLGR

SEQ ID NO: 2174 - protein, 40 aa, Artificial Sequence
  Description of Artificial Sequence: Synthetic polypeptide
YMCNSSCMGGMNRMPILTIITLEDSSGNLLGRNSFEVRVC

SEQ ID NO: 2175 - protein, 40 aa, Artificial Sequence
  Description of Artificial Sequence: Synthetic polypeptide
SCMGGMNRMPILTIITLEDSSGNLLGRNSFEVRVCACPGR

SEQ ID NO: 2176 - protein, 40 aa, Artificial Sequence
  Description of Artificial Sequence: Synthetic polypeptide
CMGGMNRMPILTIITLEDSSGNLLGRNSFEVRVCACPGRD

SEQ ID NO: 2177 - protein, 40 aa, Artificial Sequence
  Description of Artificial Sequence: Synthetic polypeptide
GGMNRMPILTIITLEDSSGNLLGRNSFEVRVCACPGRDRR

SEQ ID NO: 2178 - protein, 40 aa, Artificial Sequence
  Description of Artificial Sequence: Synthetic polypeptide
EPPEVGSDCTTIHYNYMCNSSCMGGMNRSPILTIITLEDS

SEQ ID NO: 2179 - protein, 40 aa, Artificial Sequence
  Description of Artificial Sequence: Synthetic polypeptide
NYMCNSSCMGGMNRSPILTIITLEDSSGNLLGRNSFEVRV

SEQ ID NO: 2180 - protein, 40 aa, Artificial Sequence
  Description of Artificial Sequence: Synthetic polypeptide
YMCNSSCMGGMNRSPILTIITLEDSSGNLLGRNSFEVRVC

SEQ ID NO: 2181 - protein, 40 aa, Artificial Sequence
  Description of Artificial Sequence: Synthetic polypeptide
MCNSSCMGGMNRSPILTIITLEDSSGNLLGRNSFEVRVCA

SEQ ID NO: 2182 - protein, 40 aa, Artificial Sequence
  Description of Artificial Sequence: Synthetic polypeptide
RSPILTIITLEDSSGNLLGRNSFEVRVCACPGRDRRTEEE

SEQ ID NO: 2183 - protein, 40 aa, Artificial Sequence
  Description of Artificial Sequence: Synthetic polypeptide
FRHSVVVPYEPPEVGSDCTTIHYNYMCNSSCMGGMNRRRI

SEQ ID NO: 2184 - protein, 40 aa, Artificial Sequence
  Description of Artificial Sequence: Synthetic polypeptide
VGSDCTTIHYNYMCNSSCMGGMNRRRILTIITLEDSSGNL

SEQ ID NO: 2185 - protein, 40 aa, Artificial Sequence
  Description of Artificial Sequence: Synthetic polypeptide
TIHYNYMCNSSCMGGMNRRRILTIITLEDSSGNLLGRNSF

SEQ ID NO: 2186 - protein, 40 aa, Artificial Sequence
  Description of Artificial Sequence: Synthetic polypeptide
YNYMCNSSCMGGMNRRRILTIITLEDSSGNLLGRNSFEVR

SEQ ID NO: 2187 - protein, 40 aa, Artificial Sequence
  Description of Artificial Sequence: Synthetic polypeptide
CNSSCMGGMNRRRILTIITLEDSSGNLLGRNSFEVRVCAC

SEQ ID NO: 2188 - protein, 40 aa, Artificial Sequence
  Description of Artificial Sequence: Synthetic polypeptide
CMGGMNRRRILTIITLEDSSGNLLGRNSFEVRVCACPGRD

SEQ ID NO: 2189 - protein, 40 aa, Artificial Sequence
  Description of Artificial Sequence: Synthetic polypeptide
RRILTIITLEDSSGNLLGRNSFEVRVCACPGRDRRTEEEN

SEQ ID NO: 2190 - protein, 40 aa, Artificial Sequence
  Description of Artificial Sequence: Synthetic polypeptide
PPEVGSDCTTIHYNYMCNSSCMGGMNRRPFLTIITLEDSS

SEQ ID NO: 2191 - protein, 40 aa, Artificial Sequence
  Description of Artificial Sequence: Synthetic polypeptide
YNYMCNSSCMGGMNRRPFLTIITLEDSSGNLLGRNSFEVR

SEQ ID NO: 2192 - protein, 40 aa, Artificial Sequence
  Description of Artificial Sequence: Synthetic polypeptide
MCNSSCMGGMNRRPFLTIITLEDSSGNLLGRNSFEVRVCA

SEQ ID NO: 2193 - protein, 40 aa, Artificial Sequence
  Description of Artificial Sequence: Synthetic polypeptide
NSSCMGGMNRRPFLTIITLEDSSGNLLGRNSFEVRVCACP

SEQ ID NO: 2194 - protein, 40 aa, Artificial Sequence
  Description of Artificial Sequence: Synthetic polypeptide
SSCMGGMNRRPFLTIITLEDSSGNLLGRNSFEVRVCACPG

SEQ ID NO: 2195 - protein, 40 aa, Artificial Sequence
  Description of Artificial Sequence: Synthetic polypeptide
MGGMNRRPFLTIITLEDSSGNLLGRNSFEVRVCACPGRDR

SEQ ID NO: 2196 - protein, 40 aa, Artificial Sequence
  Description of Artificial Sequence: Synthetic polypeptide
YEPPEVGSDCTTIHYNYMCNSSCMGGMNRRPNLTIITLED

SEQ ID NO: 2197 - protein, 40 aa, Artificial Sequence
  Description of Artificial Sequence: Synthetic polypeptide
PEVGSDCTTIHYNYMCNSSCMGGMNRRPNLTIITLEDSSG

SEQ ID NO: 2198 - protein, 40 aa, Artificial Sequence
  Description of Artificial Sequence: Synthetic polypeptide
SDCTTIHYNYMCNSSCMGGMNRRPNLTIITLEDSSGNLLG

SEQ ID NO: 2199 - protein, 40 aa, Artificial Sequence
  Description of Artificial Sequence: Synthetic polypeptide
DCTTIHYNYMCNSSCMGGMNRRPNLTIITLEDSSGNLLGR

SEQ ID NO: 2200 - protein, 40 aa, Artificial Sequence
  Description of Artificial Sequence: Synthetic polypeptide
IHYNYMCNSSCMGGMNRRPNLTIITLEDSSGNLLGRNSFE

SEQ ID NO: 2201 - protein, 40 aa, Artificial Sequence
  Description of Artificial Sequence: Synthetic polypeptide
YNYMCNSSCMGGMNRRPNLTIITLEDSSGNLLGRNSFEVR

SEQ ID NO: 2202 - protein, 40 aa, Artificial Sequence
  Description of Artificial Sequence: Synthetic polypeptide
MCNSSCMGGMNRRPNLTIITLEDSSGNLLGRNSFEVRVCA

SEQ ID NO: 2203 - protein, 40 aa, Artificial Sequence
  Description of Artificial Sequence: Synthetic polypeptide
SSCMGGMNRRPNLTIITLEDSSGNLLGRNSFEVRVCACPG

SEQ ID NO: 2204 - protein, 40 aa, Artificial Sequence
  Description of Artificial Sequence: Synthetic polypeptide
SCMGGMNRRPNLTIITLEDSSGNLLGRNSFEVRVCACPGR

SEQ ID NO: 2205 - protein, 40 aa, Artificial Sequence
  Description of Artificial Sequence: Synthetic polypeptide
CMGGMNRRPNLTIITLEDSSGNLLGRNSFEVRVCACPGRD

SEQ ID NO: 2206 - protein, 40 aa, Artificial Sequence
  Description of Artificial Sequence: Synthetic polypeptide
MGGMNRRPNLTIITLEDSSGNLLGRNSFEVRVCACPGRDR

SEQ ID NO: 2207 - protein, 40 aa, Artificial Sequence
  Description of Artificial Sequence: Synthetic polypeptide
GGMNRRPNLTIITLEDSSGNLLGRNSFEVRVCACPGRDRR

SEQ ID NO: 2208 - protein, 40 aa, Artificial Sequence
  Description of Artificial Sequence: Synthetic polypeptide
RRPNLTIITLEDSSGNLLGRNSFEVRVCACPGRDRRTEEE

SEQ ID NO: 2209 - protein, 40 aa, Artificial Sequence
  Description of Artificial Sequence: Synthetic polypeptide
VPYEPPEVGSDCTTIHYNYMCNSSCMGGMNRRPILAIITL

SEQ ID NO: 2210 - protein, 40 aa, Artificial Sequence
  Description of Artificial Sequence: Synthetic polypeptide
IHYNYMCNSSCMGGMNRRPILAIITLEDSSGNLLGRNSFE

SEQ ID NO: 2211 - protein, 40 aa, Artificial Sequence
  Description of Artificial Sequence: Synthetic polypeptide
HYNYMCNSSCMGGMNRRPILAIITLEDSSGNLLGRNSFEV

SEQ ID NO: 2212 - protein, 40 aa, Artificial Sequence
  Description of Artificial Sequence: Synthetic polypeptide
MGGMNRRPILAIITLEDSSGNLLGRNSFEVRVCACPGRDR

SEQ ID NO: 2213 - protein, 40 aa, Artificial Sequence
  Description of Artificial Sequence: Synthetic polypeptide
RRPILAIITLEDSSGNLLGRNSFEVRVCACPGRDRRTEEE

SEQ ID NO: 2214 - protein, 40 aa, Artificial Sequence
  Description of Artificial Sequence: Synthetic polypeptide
SDCTTIHYNYMCNSSCMGGMNRRPILTSITLEDSSGNLLG

SEQ ID NO: 2215 - protein, 40 aa, Artificial Sequence
  Description of Artificial Sequence: Synthetic polypeptide
IHYNYMCNSSCMGGMNRRPILTSITLEDSSGNLLGRNSFE

SEQ ID NO: 2216 - protein, 40 aa, Artificial Sequence
  Description of Artificial Sequence: Synthetic polypeptide
YMCNSSCMGGMNRRPILTSITLEDSSGNLLGRNSFEVRVC

SEQ ID NO: 2217 - protein, 40 aa, Artificial Sequence
  Description of Artificial Sequence: Synthetic polypeptide
MCNSSCMGGMNRRPILTSITLEDSSGNLLGRNSFEVRVCA

SEQ ID NO: 2218 - protein, 40 aa, Artificial Sequence
  Description of Artificial Sequence: Synthetic polypeptide
SCMGGMNRRPILTSITLEDSSGNLLGRNSFEVRVCACPGR

SEQ ID NO: 2219 - protein, 40 aa, Artificial Sequence
  Description of Artificial Sequence: Synthetic polypeptide
ILTSITLEDSSGNLLGRNSFEVRVCACPGRDRRTEEENLR

SEQ ID NO: 2220 - protein, 40 aa, Artificial Sequence
  Description of Artificial Sequence: Synthetic polypeptide
SDCTTIHYNYMCNSSCMGGMNRRPILTITTLEDSSGNLLG

SEQ ID NO: 2221 - protein, 40 aa, Artificial Sequence
  Description of Artificial Sequence: Synthetic polypeptide
MCNSSCMGGMNRRPILTITTLEDSSGNLLGRNSFEVRVCA

SEQ ID NO: 2222 - protein, 40 aa, Artificial Sequence
  Description of Artificial Sequence: Synthetic polypeptide
NSSCMGGMNRRPILTITTLEDSSGNLLGRNSFEVRVCACP

SEQ ID NO: 2223 - protein, 40 aa, Artificial Sequence
  Description of Artificial Sequence: Synthetic polypeptide
MGGMNRRPILTITTLEDSSGNLLGRNSFEVRVCACPGRDR

SEQ ID NO: 2224 - protein, 40 aa, Artificial Sequence
  Description of Artificial Sequence: Synthetic polypeptide
TITTLEDSSGNLLGRNSFEVRVCACPGRDRRTEEENLRKK

SEQ ID NO: 2225 - protein, 40 aa, Artificial Sequence
  Description of Artificial Sequence: Synthetic polypeptide
EPPEVGSDCTTIHYNYMCNSSCMGGMNRRPILTIIILEDS

SEQ ID NO: 2226 - protein, 40 aa, Artificial Sequence
  Description of Artificial Sequence: Synthetic polypeptide
NYMCNSSCMGGMNRRPILTIIILEDSSGNLLGRNSFEVRV

SEQ ID NO: 2227 - protein, 40 aa, Artificial Sequence
  Description of Artificial Sequence: Synthetic polypeptide
YMCNSSCMGGMNRRPILTIIILEDSSGNLLGRNSFEVRVC

SEQ ID NO: 2228 - protein, 40 aa, Artificial Sequence
  Description of Artificial Sequence: Synthetic polypeptide
CNSSCMGGMNRRPILTIIILEDSSGNLLGRNSFEVRVCAC

SEQ ID NO: 2229 - protein, 40 aa, Artificial Sequence
  Description of Artificial Sequence: Synthetic polypeptide
NSSCMGGMNRRPILTIIILEDSSGNLLGRNSFEVRVCACP

SEQ ID NO: 2230 - protein, 40 aa, Artificial Sequence
  Description of Artificial Sequence: Synthetic polypeptide
SSCMGGMNRRPILTIIILEDSSGNLLGRNSFEVRVCACPG

SEQ ID NO: 2231 - protein, 40 aa, Artificial Sequence
  Description of Artificial Sequence: Synthetic polypeptide
SCMGGMNRRPILTIIILEDSSGNLLGRNSFEVRVCACPGR

SEQ ID NO: 2232 - protein, 40 aa, Artificial Sequence
  Description of Artificial Sequence: Synthetic polypeptide
GGMNRRPILTIIILEDSSGNLLGRNSFEVRVCACPGRDRR

SEQ ID NO: 2233 - protein, 40 aa, Artificial Sequence
  Description of Artificial Sequence: Synthetic polypeptide
NRRPILTIIILEDSSGNLLGRNSFEVRVCACPGRDRRTEE

SEQ ID NO: 2234 - protein, 40 aa, Artificial Sequence
  Description of Artificial Sequence: Synthetic polypeptide
RRPILTIIILEDSSGNLLGRNSFEVRVCACPGRDRRTEEE

SEQ ID NO: 2235 - protein, 40 aa, Artificial Sequence
  Description of Artificial Sequence: Synthetic polypeptide
IILEDSSGNLLGRNSFEVRVCACPGRDRRTEEENLRKKGE

SEQ ID NO: 2236 - protein, 40 aa, Artificial Sequence
  Description of Artificial Sequence: Synthetic polypeptide
SDCTTIHYNYMCNSSCMGGMNRRPILTIITREDSSGNLLG

SEQ ID NO: 2237 - protein, 40 aa, Artificial Sequence
  Description of Artificial Sequence: Synthetic polypeptide
DCTTIHYNYMCNSSCMGGMNRRPILTIITREDSSGNLLGR

SEQ ID NO: 2238 - protein, 40 aa, Artificial Sequence
  Description of Artificial Sequence: Synthetic polypeptide
HYNYMCNSSCMGGMNRRPILTIITREDSSGNLLGRNSFEV

SEQ ID NO: 2239 - protein, 40 aa, Artificial Sequence
  Description of Artificial Sequence: Synthetic polypeptide
NYMCNSSCMGGMNRRPILTIITREDSSGNLLGRNSFEVRV

SEQ ID NO: 2240 - protein, 40 aa, Artificial Sequence
  Description of Artificial Sequence: Synthetic polypeptide
YMCNSSCMGGMNRRPILTIITREDSSGNLLGRNSFEVRVC

SEQ ID NO: 2241 - protein, 40 aa, Artificial Sequence
  Description of Artificial Sequence: Synthetic polypeptide
MCNSSCMGGMNRRPILTIITREDSSGNLLGRNSFEVRVCA

SEQ ID NO: 2242 - protein, 40 aa, Artificial Sequence
  Description of Artificial Sequence: Synthetic polypeptide
CNSSCMGGMNRRPILTIITREDSSGNLLGRNSFEVRVCAC

SEQ ID NO: 2243 - protein, 40 aa, Artificial Sequence
  Description of Artificial Sequence: Synthetic polypeptide
SSCMGGMNRRPILTIITREDSSGNLLGRNSFEVRVCACPG

SEQ ID NO: 2244 - protein, 40 aa, Artificial Sequence
  Description of Artificial Sequence: Synthetic polypeptide
SCMGGMNRRPILTIITREDSSGNLLGRNSFEVRVCACPGR

SEQ ID NO: 2245 - protein, 40 aa, Artificial Sequence
  Description of Artificial Sequence: Synthetic polypeptide
NRRPILTIITREDSSGNLLGRNSFEVRVCACPGRDRRTEE

SEQ ID NO: 2246 - protein, 40 aa, Artificial Sequence
  Description of Artificial Sequence: Synthetic polypeptide
TIITREDSSGNLLGRNSFEVRVCACPGRDRRTEEENLRKK

SEQ ID NO: 2247 - protein, 40 aa, Artificial Sequence
  Description of Artificial Sequence: Synthetic polypeptide
IITREDSSGNLLGRNSFEVRVCACPGRDRRTEEENLRKKG

SEQ ID NO: 2248 - protein, 40 aa, Artificial Sequence
  Description of Artificial Sequence: Synthetic polypeptide
ITREDSSGNLLGRNSFEVRVCACPGRDRRTEEENLRKKGE

SEQ ID NO: 2249 - protein, 40 aa, Artificial Sequence
  Description of Artificial Sequence: Synthetic polypeptide
YEPPEVGSDCTTIHYNYMCNSSCMGGMNRRPILTIITLDD

SEQ ID NO: 2250 - protein, 40 aa, Artificial Sequence
  Description of Artificial Sequence: Synthetic polypeptide
NSSCMGGMNRRPILTIITLDDSSGNLLGRNSFEVRVCACP

SEQ ID NO: 2251 - protein, 40 aa, Artificial Sequence
  Description of Artificial Sequence: Synthetic polypeptide
MGGMNRRPILTIITLDDSSGNLLGRNSFEVRVCACPGRDR

SEQ ID NO: 2252 - protein, 40 aa, Artificial Sequence
  Description of Artificial Sequence: Synthetic polypeptide
PILTIITLDDSSGNLLGRNSFEVRVCACPGRDRRTEEENL

SEQ ID NO: 2253 - protein, 40 aa, Artificial Sequence
  Description of Artificial Sequence: Synthetic polypeptide
ILTIITLDDSSGNLLGRNSFEVRVCACPGRDRRTEEENLR

SEQ ID NO: 2254 - protein, 40 aa, Artificial Sequence
  Description of Artificial Sequence: Synthetic polypeptide
IITLDDSSGNLLGRNSFEVRVCACPGRDRRTEEENLRKKG

SEQ ID NO: 2255 - protein, 40 aa, Artificial Sequence
  Description of Artificial Sequence: Synthetic polypeptide
LDDSSGNLLGRNSFEVRVCACPGRDRRTEEENLRKKGEPH

SEQ ID NO: 2256 - protein, 40 aa, Artificial Sequence
  Description of Artificial Sequence: Synthetic polypeptide
PYEPPEVGSDCTTIHYNYMCNSSCMGGMNRRPILTIITLG

SEQ ID NO: 2257 - protein, 40 aa, Artificial Sequence
  Description of Artificial Sequence: Synthetic polypeptide
YEPPEVGSDCTTIHYNYMCNSSCMGGMNRRPILTIITLGD

SEQ ID NO: 2258 - protein, 40 aa, Artificial Sequence
  Description of Artificial Sequence: Synthetic polypeptide
PPEVGSDCTTIHYNYMCNSSCMGGMNRRPILTIITLGDSS

SEQ ID NO: 2259 - protein, 40 aa, Artificial Sequence
  Description of Artificial Sequence: Synthetic polypeptide
NYMCNSSCMGGMNRRPILTIITLGDSSGNLLGRNSFEVRV

SEQ ID NO: 2260 - protein, 40 aa, Artificial Sequence
  Description of Artificial Sequence: Synthetic polypeptide
NSSCMGGMNRRPILTIITLGDSSGNLLGRNSFEVRVCACP

SEQ ID NO: 2261 - protein, 40 aa, Artificial Sequence
  Description of Artificial Sequence: Synthetic polypeptide
SSCMGGMNRRPILTIITLGDSSGNLLGRNSFEVRVCACPG

SEQ ID NO: 2262 - protein, 40 aa, Artificial Sequence
  Description of Artificial Sequence: Synthetic polypeptide
SCMGGMNRRPILTIITLGDSSGNLLGRNSFEVRVCACPGR

SEQ ID NO: 2263 - protein, 40 aa, Artificial Sequence
  Description of Artificial Sequence: Synthetic polypeptide
RRPILTIITLGDSSGNLLGRNSFEVRVCACPGRDRRTEEE

SEQ ID NO: 2264 - protein, 40 aa, Artificial Sequence
  Description of Artificial Sequence: Synthetic polypeptide
ILTIITLGDSSGNLLGRNSFEVRVCACPGRDRRTEEENLR

SEQ ID NO: 2265 - protein, 40 aa, Artificial Sequence
  Description of Artificial Sequence: Synthetic polypeptide
YEPPEVGSDCTTIHYNYMCNSSCMGGMNRRPILTIITLKD

SEQ ID NO: 2266 - protein, 40 aa, Artificial Sequence
  Description of Artificial Sequence: Synthetic polypeptide
PPEVGSDCTTIHYNYMCNSSCMGGMNRRPILTIITLKDSS

SEQ ID NO: 2267 - protein, 40 aa, Artificial Sequence
  Description of Artificial Sequence: Synthetic polypeptide
VGSDCTTIHYNYMCNSSCMGGMNRRPILTIITLKDSSGNL

SEQ ID NO: 2268 - protein, 40 aa, Artificial Sequence
  Description of Artificial Sequence: Synthetic polypeptide
YMCNSSCMGGMNRRPILTIITLKDSSGNLLGRNSFEVRVC

SEQ ID NO: 2269 - protein, 40 aa, Artificial Sequence
  Description of Artificial Sequence: Synthetic polypeptide
CNSSCMGGMNRRPILTIITLKDSSGNLLGRNSFEVRVCAC

SEQ ID NO: 2270 - protein, 40 aa, Artificial Sequence
  Description of Artificial Sequence: Synthetic polypeptide
CMGGMNRRPILTIITLKDSSGNLLGRNSFEVRVCACPGRD

SEQ ID NO: 2271 - protein, 40 aa, Artificial Sequence
  Description of Artificial Sequence: Synthetic polypeptide
YMCNSSCMGGMNRRPILTIITLEVSSGNLLGRNSFEVRVC

SEQ ID NO: 2272 - protein, 40 aa, Artificial Sequence
  Description of Artificial Sequence: Synthetic polypeptide
SSCMGGMNRRPILTIITLEVSSGNLLGRNSFEVRVCACPG

SEQ ID NO: 2273 - protein, 40 aa, Artificial Sequence
  Description of Artificial Sequence: Synthetic polypeptide
MGGMNRRPILTIITLEVSSGNLLGRNSFEVRVCACPGRDR

SEQ ID NO: 2274 - protein, 40 aa, Artificial Sequence
  Description of Artificial Sequence: Synthetic polypeptide
LTIITLEVSSGNLLGRNSFEVRVCACPGRDRRTEEENLRK

SEQ ID NO: 2275 - protein, 40 aa, Artificial Sequence
  Description of Artificial Sequence: Synthetic polypeptide
YEPPEVGSDCTTIHYNYMCNSSCMGGMNRRPILTIITLEY

SEQ ID NO: 2276 - protein, 40 aa, Artificial Sequence
  Description of Artificial Sequence: Synthetic polypeptide
YNYMCNSSCMGGMNRRPILTIITLEYSSGNLLGRNSFEVR

SEQ ID NO: 2277 - protein, 40 aa, Artificial Sequence
  Description of Artificial Sequence: Synthetic polypeptide
NYMCNSSCMGGMNRRPILTIITLEYSSGNLLGRNSFEVRV

SEQ ID NO: 2278 - protein, 40 aa, Artificial Sequence
  Description of Artificial Sequence: Synthetic polypeptide
YMCNSSCMGGMNRRPILTIITLEYSSGNLLGRNSFEVRVC

SEQ ID NO: 2279 - protein, 40 aa, Artificial Sequence
  Description of Artificial Sequence: Synthetic polypeptide
NSSCMGGMNRRPILTIITLEYSSGNLLGRNSFEVRVCACP

SEQ ID NO: 2280 - protein, 40 aa, Artificial Sequence
  Description of Artificial Sequence: Synthetic polypeptide
CMGGMNRRPILTIITLEYSSGNLLGRNSFEVRVCACPGRD

SEQ ID NO: 2281 - protein, 40 aa, Artificial Sequence
  Description of Artificial Sequence: Synthetic polypeptide
RPILTIITLEYSSGNLLGRNSFEVRVCACPGRDRRTEEEN

SEQ ID NO: 2282 - protein, 40 aa, Artificial Sequence
  Description of Artificial Sequence: Synthetic polypeptide
ILTIITLEYSSGNLLGRNSFEVRVCACPGRDRRTEEENLR

SEQ ID NO: 2283 - protein, 40 aa, Artificial Sequence
  Description of Artificial Sequence: Synthetic polypeptide
LTIITLEYSSGNLLGRNSFEVRVCACPGRDRRTEEENLRK

SEQ ID NO: 2284 - protein, 40 aa, Artificial Sequence
  Description of Artificial Sequence: Synthetic polypeptide
MCNSSCMGGMNRRPILTIITLEDSSVNLLGRNSFEVRVCA

SEQ ID NO: 2285 - protein, 40 aa, Artificial Sequence
  Description of Artificial Sequence: Synthetic polypeptide
MNRRPILTIITLEDSSVNLLGRNSFEVRVCACPGRDRRTE

SEQ ID NO: 2286 - protein, 40 aa, Artificial Sequence
  Description of Artificial Sequence: Synthetic polypeptide
PILTIITLEDSSVNLLGRNSFEVRVCACPGRDRRTEEENL

SEQ ID NO: 2287 - protein, 40 aa, Artificial Sequence
  Description of Artificial Sequence: Synthetic polypeptide
YNYMCNSSCMGGMNRRPILTIITLEDSSGNLPGRNSFEVR

SEQ ID NO: 2288 - protein, 40 aa, Artificial Sequence
  Description of Artificial Sequence: Synthetic polypeptide
NYMCNSSCMGGMNRRPILTIITLEDSSGNLPGRNSFEVRV

SEQ ID NO: 2289 - protein, 40 aa, Artificial Sequence
  Description of Artificial Sequence: Synthetic polypeptide
YMCNSSCMGGMNRRPILTIITLEDSSGNLPGRNSFEVRVC

SEQ ID NO: 2290 - protein, 40 aa, Artificial Sequence
  Description of Artificial Sequence: Synthetic polypeptide
SSCMGGMNRRPILTIITLEDSSGNLPGRNSFEVRVCACPG

SEQ ID NO: 2291 - protein, 40 aa, Artificial Sequence
  Description of Artificial Sequence: Synthetic polypeptide
SCMGGMNRRPILTIITLEDSSGNLPGRNSFEVRVCACPGR

SEQ ID NO: 2292 - protein, 40 aa, Artificial Sequence
  Description of Artificial Sequence: Synthetic polypeptide
GMNRRPILTIITLEDSSGNLPGRNSFEVRVCACPGRDRRT

SEQ ID NO: 2293 - protein, 40 aa, Artificial Sequence
  Description of Artificial Sequence: Synthetic polypeptide
PILTIITLEDSSGNLPGRNSFEVRVCACPGRDRRTEEENL

SEQ ID NO: 2294 - protein, 40 aa, Artificial Sequence
  Description of Artificial Sequence: Synthetic polypeptide
DCTTIHYNYMCNSSCMGGMNRRPILTIITLEDSSGNLLRR

SEQ ID NO: 2295 - protein, 40 aa, Artificial Sequence
  Description of Artificial Sequence: Synthetic polypeptide
TIHYNYMCNSSCMGGMNRRPILTIITLEDSSGNLLRRNSF

SEQ ID NO: 2296 - protein, 40 aa, Artificial Sequence
  Description of Artificial Sequence: Synthetic polypeptide
YNYMCNSSCMGGMNRRPILTIITLEDSSGNLLRRNSFEVR

SEQ ID NO: 2297 - protein, 40 aa, Artificial Sequence
  Description of Artificial Sequence: Synthetic polypeptide
NYMCNSSCMGGMNRRPILTIITLEDSSGNLLRRNSFEVRV

SEQ ID NO: 2298 - protein, 40 aa, Artificial Sequence
  Description of Artificial Sequence: Synthetic polypeptide
YMCNSSCMGGMNRRPILTIITLEDSSGNLLRRNSFEVRVC

SEQ ID NO: 2299 - protein, 40 aa, Artificial Sequence
  Description of Artificial Sequence: Synthetic polypeptide
MCNSSCMGGMNRRPILTIITLEDSSGNLLRRNSFEVRVCA

SEQ ID NO: 2300 - protein, 40 aa, Artificial Sequence
  Description of Artificial Sequence: Synthetic polypeptide
CNSSCMGGMNRRPILTIITLEDSSGNLLRRNSFEVRVCAC

SEQ ID NO: 2301 - protein, 40 aa, Artificial Sequence
  Description of Artificial Sequence: Synthetic polypeptide
NSSCMGGMNRRPILTIITLEDSSGNLLRRNSFEVRVCACP

SEQ ID NO: 2302 - protein, 40 aa, Artificial Sequence
  Description of Artificial Sequence: Synthetic polypeptide
SSCMGGMNRRPILTIITLEDSSGNLLRRNSFEVRVCACPG

SEQ ID NO: 2303 - protein, 40 aa, Artificial Sequence
  Description of Artificial Sequence: Synthetic polypeptide
TLEDSSGNLLRRNSFEVRVCACPGRDRRTEEENLRKKGEP

SEQ ID NO: 2304 - protein, 40 aa, Artificial Sequence
  Description of Artificial Sequence: Synthetic polypeptide
LEDSSGNLLRRNSFEVRVCACPGRDRRTEEENLRKKGEPH

SEQ ID NO: 2305 - protein, 40 aa, Artificial Sequence
  Description of Artificial Sequence: Synthetic polypeptide
NYMCNSSCMGGMNRRPILTIITLEDSSGNLLVRNSFEVRV

SEQ ID NO: 2306 - protein, 40 aa, Artificial Sequence
  Description of Artificial Sequence: Synthetic polypeptide
MCNSSCMGGMNRRPILTIITLEDSSGNLLVRNSFEVRVCA

SEQ ID NO: 2307 - protein, 40 aa, Artificial Sequence
  Description of Artificial Sequence: Synthetic polypeptide
SCMGGMNRRPILTIITLEDSSGNLLVRNSFEVRVCACPGR

SEQ ID NO: 2308 - protein, 40 aa, Artificial Sequence
  Description of Artificial Sequence: Synthetic polypeptide
MGGMNRRPILTIITLEDSSGNLLVRNSFEVRVCACPGRDR

SEQ ID NO: 2309 - protein, 40 aa, Artificial Sequence
  Description of Artificial Sequence: Synthetic polypeptide
GGMNRRPILTIITLEDSSGNLLVRNSFEVRVCACPGRDRR

SEQ ID NO: 2310 - protein, 40 aa, Artificial Sequence
  Description of Artificial Sequence: Synthetic polypeptide
GMNRRPILTIITLEDSSGNLLVRNSFEVRVCACPGRDRRT

SEQ ID NO: 2311 - protein, 40 aa, Artificial Sequence
  Description of Artificial Sequence: Synthetic polypeptide
CTTIHYNYMCNSSCMGGMNRRPILTIITLEDSSGNLLGQN

SEQ ID NO: 2312 - protein, 40 aa, Artificial Sequence
  Description of Artificial Sequence: Synthetic polypeptide
HYNYMCNSSCMGGMNRRPILTIITLEDSSGNLLGQNSFEV

SEQ ID NO: 2313 - protein, 40 aa, Artificial Sequence
  Description of Artificial Sequence: Synthetic polypeptide
NSSCMGGMNRRPILTIITLEDSSGNLLGQNSFEVRVCACP

SEQ ID NO: 2314 - protein, 40 aa, Artificial Sequence
  Description of Artificial Sequence: Synthetic polypeptide
MGGMNRRPILTIITLEDSSGNLLGQNSFEVRVCACPGRDR

SEQ ID NO: 2315 - protein, 40 aa, Artificial Sequence
  Description of Artificial Sequence: Synthetic polypeptide
GMNRRPILTIITLEDSSGNLLGQNSFEVRVCACPGRDRRT

SEQ ID NO: 2316 - protein, 40 aa, Artificial Sequence
  Description of Artificial Sequence: Synthetic polypeptide
SSGNLLGQNSFEVRVCACPGRDRRTEEENLRKKGEPHHEL

SEQ ID NO: 2317 - protein, 40 aa, Artificial Sequence
  Description of Artificial Sequence: Synthetic polypeptide
GQNSFEVRVCACPGRDRRTEEENLRKKGEPHHELPPGSTK

SEQ ID NO: 2318 - protein, 40 aa, Artificial Sequence
  Description of Artificial Sequence: Synthetic polypeptide
QNSFEVRVCACPGRDRRTEEENLRKKGEPHHELPPGSTKR

SEQ ID NO: 2319 - protein, 40 aa, Artificial Sequence
  Description of Artificial Sequence: Synthetic polypeptide
DCTTIHYNYMCNSSCMGGMNRRPILTIITLEDSSGNLLGW

SEQ ID NO: 2320 - protein, 40 aa, Artificial Sequence
  Description of Artificial Sequence: Synthetic polypeptide
MCNSSCMGGMNRRPILTIITLEDSSGNLLGWNSFEVRVCA

SEQ ID NO: 2321 - protein, 40 aa, Artificial Sequence
  Description of Artificial Sequence: Synthetic polypeptide
ITLEDSSGNLLGWNSFEVRVCACPGRDRRTEEENLRKKGE

SEQ ID NO: 2322 - protein, 40 aa, Artificial Sequence
  Description of Artificial Sequence: Synthetic polypeptide
TIHYNYMCNSSCMGGMNRRPILTIITLEDSSGNLLGRNSS

SEQ ID NO: 2323 - protein, 40 aa, Artificial Sequence
  Description of Artificial Sequence: Synthetic polypeptide
HYNYMCNSSCMGGMNRRPILTIITLEDSSGNLLGRNSSEV

SEQ ID NO: 2324 - protein, 40 aa, Artificial Sequence
  Description of Artificial Sequence: Synthetic polypeptide
YNYMCNSSCMGGMNRRPILTIITLEDSSGNLLGRNSSEVR

SEQ ID NO: 2325 - protein, 40 aa, Artificial Sequence
  Description of Artificial Sequence: Synthetic polypeptide
YMCNSSCMGGMNRRPILTIITLEDSSGNLLGRNSSEVRVC

SEQ ID NO: 2326 - protein, 40 aa, Artificial Sequence
  Description of Artificial Sequence: Synthetic polypeptide
GGMNRRPILTIITLEDSSGNLLGRNSSEVRVCACPGRDRR

SEQ ID NO: 2327 - protein, 40 aa, Artificial Sequence
  Description of Artificial Sequence: Synthetic polypeptide
MNRRPILTIITLEDSSGNLLGRNSSEVRVCACPGRDRRTE

SEQ ID NO: 2328 - protein, 40 aa, Artificial Sequence
  Description of Artificial Sequence: Synthetic polypeptide
SSGNLLGRNSSEVRVCACPGRDRRTEEENLRKKGEPHHEL

SEQ ID NO: 2329 - protein, 40 aa, Artificial Sequence
  Description of Artificial Sequence: Synthetic polypeptide
SGNLLGRNSSEVRVCACPGRDRRTEEENLRKKGEPHHELP

SEQ ID NO: 2330 - protein, 40 aa, Artificial Sequence
  Description of Artificial Sequence: Synthetic polypeptide
MCNSSCMGGMNRRPILTIITLEDSSGNLLGRNSVEVRVCA

SEQ ID NO: 2331 - protein, 40 aa, Artificial Sequence
  Description of Artificial Sequence: Synthetic polypeptide
CMGGMNRRPILTIITLEDSSGNLLGRNSVEVRVCACPGRD

SEQ ID NO: 2332 - protein, 40 aa, Artificial Sequence
  Description of Artificial Sequence: Synthetic polypeptide
GGMNRRPILTIITLEDSSGNLLGRNSVEVRVCACPGRDRR

SEQ ID NO: 2333 - protein, 40 aa, Artificial Sequence
  Description of Artificial Sequence: Synthetic polypeptide
GMNRRPILTIITLEDSSGNLLGRNSVEVRVCACPGRDRRT

SEQ ID NO: 2334 - protein, 40 aa, Artificial Sequence
  Description of Artificial Sequence: Synthetic polypeptide
NRRPILTIITLEDSSGNLLGRNSVEVRVCACPGRDRRTEE

SEQ ID NO: 2335 - protein, 40 aa, Artificial Sequence
  Description of Artificial Sequence: Synthetic polypeptide
TLEDSSGNLLGRNSVEVRVCACPGRDRRTEEENLRKKGEP

SEQ ID NO: 2336 - protein, 40 aa, Artificial Sequence
  Description of Artificial Sequence: Synthetic polypeptide
LEDSSGNLLGRNSVEVRVCACPGRDRRTEEENLRKKGEPH

SEQ ID NO: 2337 - protein, 40 aa, Artificial Sequence
  Description of Artificial Sequence: Synthetic polypeptide
MCNSSCMGGMNRRPILTIITLEDSSGNLLGRNSFKVRVCA

SEQ ID NO: 2338 - protein, 40 aa, Artificial Sequence
  Description of Artificial Sequence: Synthetic polypeptide
NSSCMGGMNRRPILTIITLEDSSGNLLGRNSFKVRVCACP

SEQ ID NO: 2339 - protein, 40 aa, Artificial Sequence
  Description of Artificial Sequence: Synthetic polypeptide
IITLEDSSGNLLGRNSFVVRVCACPGRDRRTEEENLRKKG

SEQ ID NO: 2340 - protein, 40 aa, Artificial Sequence
  Description of Artificial Sequence: Synthetic polypeptide
SGNLLGRNSFVVRVCACPGRDRRTEEENLRKKGEPHHELP

SEQ ID NO: 2341 - protein, 40 aa, Artificial Sequence
  Description of Artificial Sequence: Synthetic polypeptide
NLLGRNSFVVRVCACPGRDRRTEEENLRKKGEPHHELPPG

SEQ ID NO: 2342 - protein, 40 aa, Artificial Sequence
  Description of Artificial Sequence: Synthetic polypeptide
CMGGMNRRPILTIITLEDSSGNLLGRNSFEGRVCACPGRD

SEQ ID NO: 2343 - protein, 40 aa, Artificial Sequence
  Description of Artificial Sequence: Synthetic polypeptide
MGGMNRRPILTIITLEDSSGNLLGRNSFEMRVCACPGRDR

SEQ ID NO: 2344 - protein, 40 aa, Artificial Sequence
  Description of Artificial Sequence: Synthetic polypeptide
PILTIITLEDSSGNLLGRNSFEMRVCACPGRDRRTEEENL

SEQ ID NO: 2345 - protein, 40 aa, Artificial Sequence
  Description of Artificial Sequence: Synthetic polypeptide
IITLEDSSGNLLGRNSFEMRVCACPGRDRRTEEENLRKKG

SEQ ID NO: 2346 - protein, 40 aa, Artificial Sequence
  Description of Artificial Sequence: Synthetic polypeptide
NLLGRNSFEMRVCACPGRDRRTEEENLRKKGEPHHELPPG

SEQ ID NO: 2347 - protein, 40 aa, Artificial Sequence
  Description of Artificial Sequence: Synthetic polypeptide
GRNSFEMRVCACPGRDRRTEEENLRKKGEPHHELPPGSTK

SEQ ID NO: 2348 - protein, 40 aa, Artificial Sequence
  Description of Artificial Sequence: Synthetic polypeptide
CNSSCMGGMNRRPILTIITLEDSSGNLLGRNSFEVCVCAC

SEQ ID NO: 2349 - protein, 40 aa, Artificial Sequence
  Description of Artificial Sequence: Synthetic polypeptide
NSSCMGGMNRRPILTIITLEDSSGNLLGRNSFEVCVCACP

SEQ ID NO: 2350 - protein, 40 aa, Artificial Sequence
  Description of Artificial Sequence: Synthetic polypeptide
EVCVCACPGRDRRTEEENLRKKGEPHHELPPGSTKRALPN

SEQ ID NO: 2351 - protein, 40 aa, Artificial Sequence
  Description of Artificial Sequence: Synthetic polypeptide
MGGMNRRPILTIITLEDSSGNLLGRNSFEVHVCACPGRDR

SEQ ID NO: 2352 - protein, 40 aa, Artificial Sequence
  Description of Artificial Sequence: Synthetic polypeptide
ITLEDSSGNLLGRNSFEVHVCACPGRDRRTEEENLRKKGE

SEQ ID NO: 2353 - protein, 40 aa, Artificial Sequence
  Description of Artificial Sequence: Synthetic polypeptide
YMCNSSCMGGMNRRPILTIITLEDSSGNLLGRNSFEVRGC

SEQ ID NO: 2354 - protein, 40 aa, Artificial Sequence
  Description of Artificial Sequence: Synthetic polypeptide
GGMNRRPILTIITLEDSSGNLLGRNSFEVRGCACPGRDRR

SEQ ID NO: 2355 - protein, 40 aa, Artificial Sequence
  Description of Artificial Sequence: Synthetic polypeptide
GMNRRPILTIITLEDSSGNLLGRNSFEVRGCACPGRDRRT

SEQ ID NO: 2356 - protein, 40 aa, Artificial Sequence
  Description of Artificial Sequence: Synthetic polypeptide
LEDSSGNLLGRNSFEVRGCACPGRDRRTEEENLRKKGEPH

SEQ ID NO: 2357 - protein, 40 aa, Artificial Sequence
  Description of Artificial Sequence: Synthetic polypeptide
SFEVRGCACPGRDRRTEEENLRKKGEPHHELPPGSTKRAL

SEQ ID NO: 2358 - protein, 40 aa, Artificial Sequence
  Description of Artificial Sequence: Synthetic polypeptide
GCACPGRDRRTEEENLRKKGEPHHELPPGSTKRALPNNTS

SEQ ID NO: 2359 - protein, 40 aa, Artificial Sequence
  Description of Artificial Sequence: Synthetic polypeptide
YMCNSSCMGGMNRRPILTIITLEDSSGNLLGRNSFEVRLC

SEQ ID NO: 2360 - protein, 40 aa, Artificial Sequence
  Description of Artificial Sequence: Synthetic polypeptide
CNSSCMGGMNRRPILTIITLEDSSGNLLGRNSFEVRLCAC

SEQ ID NO: 2361 - protein, 40 aa, Artificial Sequence
  Description of Artificial Sequence: Synthetic polypeptide
SSCMGGMNRRPILTIITLEDSSGNLLGRNSFEVRLCACPG

SEQ ID NO: 2362 - protein, 40 aa, Artificial Sequence
  Description of Artificial Sequence: Synthetic polypeptide
CMGGMNRRPILTIITLEDSSGNLLGRNSFEVRLCACPGRD

SEQ ID NO: 2363 - protein, 40 aa, Artificial Sequence
  Description of Artificial Sequence: Synthetic polypeptide
LTIITLEDSSGNLLGRNSFEVRLCACPGRDRRTEEENLRK

SEQ ID NO: 2364 - protein, 40 aa, Artificial Sequence
  Description of Artificial Sequence: Synthetic polypeptide
DSSGNLLGRNSFEVRLCACPGRDRRTEEENLRKKGEPHHE

SEQ ID NO: 2365 - protein, 40 aa, Artificial Sequence
  Description of Artificial Sequence: Synthetic polypeptide
YMCNSSCMGGMNRRPILTIITLEDSSGNLLGRNSFEVRVG

SEQ ID NO: 2366 - protein, 40 aa, Artificial Sequence
  Description of Artificial Sequence: Synthetic polypeptide
SSCMGGMNRRPILTIITLEDSSGNLLGRNSFEVRVGACPG

SEQ ID NO: 2367 - protein, 40 aa, Artificial Sequence
  Description of Artificial Sequence: Synthetic polypeptide
GMNRRPILTIITLEDSSGNLLGRNSFEVRVGACPGRDRRT

SEQ ID NO: 2368 - protein, 40 aa, Artificial Sequence
  Description of Artificial Sequence: Synthetic polypeptide
SGNLLGRNSFEVRVGACPGRDRRTEEENLRKKGEPHHELP

SEQ ID NO: 2369 - protein, 40 aa, Artificial Sequence
  Description of Artificial Sequence: Synthetic polypeptide
NSSCMGGMNRRPILTIITLEDSSGNLLGRNSFEVRVYACP

SEQ ID NO: 2370 - protein, 40 aa, Artificial Sequence
  Description of Artificial Sequence: Synthetic polypeptide
MGGMNRRPILTIITLEDSSGNLLGRNSFEVRVYACPGRDR

SEQ ID NO: 2371 - protein, 40 aa, Artificial Sequence
  Description of Artificial Sequence: Synthetic polypeptide
TLEDSSGNLLGRNSFEVRVYACPGRDRRTEEENLRKKGEP

SEQ ID NO: 2372 - protein, 40 aa, Artificial Sequence
  Description of Artificial Sequence: Synthetic polypeptide
SSCMGGMNRRPILTIITLEDSSGNLLGRNSFEVRVCGCPG

SEQ ID NO: 2373 - protein, 40 aa, Artificial Sequence
  Description of Artificial Sequence: Synthetic polypeptide
GMNRRPILTIITLEDSSGNLLGRNSFEVRVCGCPGRDRRT

SEQ ID NO: 2374 - protein, 40 aa, Artificial Sequence
  Description of Artificial Sequence: Synthetic polypeptide
TIITLEDSSGNLLGRNSFEVRVCGCPGRDRRTEEENLRKK

SEQ ID NO: 2375 - protein, 40 aa, Artificial Sequence
  Description of Artificial Sequence: Synthetic polypeptide
ITLEDSSGNLLGRNSFEVRVCGCPGRDRRTEEENLRKKGE

SEQ ID NO: 2376 - protein, 40 aa, Artificial Sequence
  Description of Artificial Sequence: Synthetic polypeptide
NLLGRNSFEVRVCGCPGRDRRTEEENLRKKGEPHHELPPG

SEQ ID NO: 2377 - protein, 40 aa, Artificial Sequence
  Description of Artificial Sequence: Synthetic polypeptide
CGCPGRDRRTEEENLRKKGEPHHELPPGSTKRALPNNTSS

SEQ ID NO: 2378 - protein, 40 aa, Artificial Sequence
  Description of Artificial Sequence: Synthetic polypeptide
SCMGGMNRRPILTIITLEDSSGNLLGRNSFEVRVCPCPGR

SEQ ID NO: 2379 - protein, 40 aa, Artificial Sequence
  Description of Artificial Sequence: Synthetic polypeptide
CMGGMNRRPILTIITLEDSSGNLLGRNSFEVRVCPCPGRD

SEQ ID NO: 2380 - protein, 40 aa, Artificial Sequence
  Description of Artificial Sequence: Synthetic polypeptide
MNRRPILTIITLEDSSGNLLGRNSFEVRVCPCPGRDRRTE

SEQ ID NO: 2381 - protein, 40 aa, Artificial Sequence
  Description of Artificial Sequence: Synthetic polypeptide
GRNSFEVRVCPCPGRDRRTEEENLRKKGEPHHELPPGSTK

SEQ ID NO: 2382 - protein, 40 aa, Artificial Sequence
  Description of Artificial Sequence: Synthetic polypeptide
MNRRPILTIITLEDSSGNLLGRNSFEVRVCAGPGRDRRTE

SEQ ID NO: 2383 - protein, 40 aa, Artificial Sequence
  Description of Artificial Sequence: Synthetic polypeptide
GNLLGRNSFEVRVCAGPGRDRRTEEENLRKKGEPHHELPP

SEQ ID NO: 2384 - protein, 40 aa, Artificial Sequence
  Description of Artificial Sequence: Synthetic polypeptide
NSSCMGGMNRRPILTIITLEDSSGNLLGRNSFEVRVCAYP

SEQ ID NO: 2385 - protein, 40 aa, Artificial Sequence
  Description of Artificial Sequence: Synthetic polypeptide
SSCMGGMNRRPILTIITLEDSSGNLLGRNSFEVRVCAYPG

SEQ ID NO: 2386 - protein, 40 aa, Artificial Sequence
  Description of Artificial Sequence: Synthetic polypeptide
GGMNRRPILTIITLEDSSGNLLGRNSFEVRVCAYPGRDRR

SEQ ID NO: 2387 - protein, 40 aa, Artificial Sequence
  Description of Artificial Sequence: Synthetic polypeptide
GMNRRPILTIITLEDSSGNLLGRNSFEVRVCAYPGRDRRT

SEQ ID NO: 2388 - protein, 40 aa, Artificial Sequence
  Description of Artificial Sequence: Synthetic polypeptide
SSGNLLGRNSFEVRVCAYPGRDRRTEEENLRKKGEPHHEL

SEQ ID NO: 2389 - protein, 40 aa, Artificial Sequence
  Description of Artificial Sequence: Synthetic polypeptide
CMGGMNRRPILTIITLEDSSGNLLGRNSFEVRVCACRGRD

SEQ ID NO: 2390 - protein, 40 aa, Artificial Sequence
  Description of Artificial Sequence: Synthetic polypeptide
LTIITLEDSSGNLLGRNSFEVRVCACRGRDRRTEEENLRK

SEQ ID NO: 2391 - protein, 40 aa, Artificial Sequence
  Description of Artificial Sequence: Synthetic polypeptide
TIITLEDSSGNLLGRNSFEVRVCACRGRDRRTEEENLRKK

SEQ ID NO: 2392 - protein, 40 aa, Artificial Sequence
  Description of Artificial Sequence: Synthetic polypeptide
LEDSSGNLLGRNSFEVRVCACRGRDRRTEEENLRKKGEPH

SEQ ID NO: 2393 - protein, 40 aa, Artificial Sequence
  Description of Artificial Sequence: Synthetic polypeptide
DSSGNLLGRNSFEVRVCACRGRDRRTEEENLRKKGEPHHE

SEQ ID NO: 2394 - protein, 40 aa, Artificial Sequence
  Description of Artificial Sequence: Synthetic polypeptide
SSCMGGMNRRPILTIITLEDSSGNLLGRNSFEVRVCACSG

SEQ ID NO: 2395 - protein, 40 aa, Artificial Sequence
  Description of Artificial Sequence: Synthetic polypeptide
GMNRRPILTIITLEDSSGNLLGRNSFEVRVCACSGRDRRT

SEQ ID NO: 2396 - protein, 40 aa, Artificial Sequence
  Description of Artificial Sequence: Synthetic polypeptide
MNRRPILTIITLEDSSGNLLGRNSFEVRVCACSGRDRRTE

SEQ ID NO: 2397 - protein, 40 aa, Artificial Sequence
  Description of Artificial Sequence: Synthetic polypeptide
ILTIITLEDSSGNLLGRNSFEVRVCACSGRDRRTEEENLR

SEQ ID NO: 2398 - protein, 40 aa, Artificial Sequence
  Description of Artificial Sequence: Synthetic polypeptide
EDSSGNLLGRNSFEVRVCACSGRDRRTEEENLRKKGEPHH

SEQ ID NO: 2399 - protein, 40 aa, Artificial Sequence
  Description of Artificial Sequence: Synthetic polypeptide
SGNLLGRNSFEVRVCACSGRDRRTEEENLRKKGEPHHELP

SEQ ID NO: 2400 - protein, 40 aa, Artificial Sequence
  Description of Artificial Sequence: Synthetic polypeptide
NLLGRNSFEVRVCACSGRDRRTEEENLRKKGEPHHELPPG

SEQ ID NO: 2401 - protein, 40 aa, Artificial Sequence
  Description of Artificial Sequence: Synthetic polypeptide
CSGRDRRTEEENLRKKGEPHHELPPGSTKRALPNNTSSSP

SEQ ID NO: 2402 - protein, 40 aa, Artificial Sequence
  Description of Artificial Sequence: Synthetic polypeptide
SSCMGGMNRRPILTIITLEDSSGNLLGRNSFEVRVCACPE

SEQ ID NO: 2403 - protein, 40 aa, Artificial Sequence
  Description of Artificial Sequence: Synthetic polypeptide
CMGGMNRRPILTIITLEDSSGNLLGRNSFEVRVCACPERD

SEQ ID NO: 2404 - protein, 40 aa, Artificial Sequence
  Description of Artificial Sequence: Synthetic polypeptide
MGGMNRRPILTIITLEDSSGNLLGRNSFEVRVCACPERDR

SEQ ID NO: 2405 - protein, 40 aa, Artificial Sequence
  Description of Artificial Sequence: Synthetic polypeptide
GGMNRRPILTIITLEDSSGNLLGRNSFEVRVCACPERDRR

SEQ ID NO: 2406 - protein, 40 aa, Artificial Sequence
  Description of Artificial Sequence: Synthetic polypeptide
RPILTIITLEDSSGNLLGRNSFEVRVCACPERDRRTEEEN

SEQ ID NO: 2407 - protein, 40 aa, Artificial Sequence
  Description of Artificial Sequence: Synthetic polypeptide
IITLEDSSGNLLGRNSFEVRVCACPERDRRTEEENLRKKG

SEQ ID NO: 2408 - protein, 40 aa, Artificial Sequence
  Description of Artificial Sequence: Synthetic polypeptide
TLEDSSGNLLGRNSFEVRVCACPERDRRTEEENLRKKGEP

SEQ ID NO: 2409 - protein, 40 aa, Artificial Sequence
  Description of Artificial Sequence: Synthetic polypeptide
SGNLLGRNSFEVRVCACPERDRRTEEENLRKKGEPHHELP

SEQ ID NO: 2410 - protein, 40 aa, Artificial Sequence
  Description of Artificial Sequence: Synthetic polypeptide
PERDRRTEEENLRKKGEPHHELPPGSTKRALPNNTSSSPQ

SEQ ID NO: 2411 - protein, 40 aa, Artificial Sequence
  Description of Artificial Sequence: Synthetic polypeptide
CMGGMNRRPILTIITLEDSSGNLLGRNSFEVRVCACPRRD

SEQ ID NO: 2412 - protein, 40 aa, Artificial Sequence
  Description of Artificial Sequence: Synthetic polypeptide
MGGMNRRPILTIITLEDSSGNLLGRNSFEVRVCACPRRDR

SEQ ID NO: 2413 - protein, 40 aa, Artificial Sequence
  Description of Artificial Sequence: Synthetic polypeptide
SCMGGMNRRPILTIITLEDSSGNLLGRNSFEVRVCACPGK

SEQ ID NO: 2414 - protein, 40 aa, Artificial Sequence
  Description of Artificial Sequence: Synthetic polypeptide
CMGGMNRRPILTIITLEDSSGNLLGRNSFEVRVCACPGKD

SEQ ID NO: 2415 - protein, 40 aa, Artificial Sequence
  Description of Artificial Sequence: Synthetic polypeptide
IITLEDSSGNLLGRNSFEVRVCACPGKDRRTEEENLRKKG

SEQ ID NO: 2416 - protein, 40 aa, Artificial Sequence
  Description of Artificial Sequence: Synthetic polypeptide
SGNLLGRNSFEVRVCACPGKDRRTEEENLRKKGEPHHELP

SEQ ID NO: 2417 - protein, 40 aa, Artificial Sequence
  Description of Artificial Sequence: Synthetic polypeptide
GNLLGRNSFEVRVCACPGKDRRTEEENLRKKGEPHHELPP

SEQ ID NO: 2418 - protein, 40 aa, Artificial Sequence
  Description of Artificial Sequence: Synthetic polypeptide
MNRRPILTIITLEDSSGNLLGRNSFEVRVCACPGSDRRTE

SEQ ID NO: 2419 - protein, 40 aa, Artificial Sequence
  Description of Artificial Sequence: Synthetic polypeptide
LEDSSGNLLGRNSFEVRVCACPGSDRRTEEENLRKKGEPH

SEQ ID NO: 2420 - protein, 40 aa, Artificial Sequence
  Description of Artificial Sequence: Synthetic polypeptide
NLLGRNSFEVRVCACPGSDRRTEEENLRKKGEPHHELPPG

SEQ ID NO: 2421 - protein, 40 aa, Artificial Sequence
  Description of Artificial Sequence: Synthetic polypeptide
GRNSFEVRVCACPGSDRRTEEENLRKKGEPHHELPPGSTK

SEQ ID NO: 2422 - protein, 40 aa, Artificial Sequence
  Description of Artificial Sequence: Synthetic polypeptide
FEVRVCACPGSDRRTEEENLRKKGEPHHELPPGSTKRALP

SEQ ID NO: 2423 - protein, 40 aa, Artificial Sequence
  Description of Artificial Sequence: Synthetic polypeptide
CMGGMNRRPILTIITLEDSSGNLLGRNSFEVRVCACPGRE

SEQ ID NO: 2424 - protein, 40 aa, Artificial Sequence
  Description of Artificial Sequence: Synthetic polypeptide
MNRRPILTIITLEDSSGNLLGRNSFEVRVCACPGRERRTE

SEQ ID NO: 2425 - protein, 40 aa, Artificial Sequence
  Description of Artificial Sequence: Synthetic polypeptide
SSGNLLGRNSFEVRVCACPGRERRTEEENLRKKGEPHHEL

SEQ ID NO: 2426 - protein, 40 aa, Artificial Sequence
  Description of Artificial Sequence: Synthetic polypeptide
SFEVRVCACPGRERRTEEENLRKKGEPHHELPPGSTKRAL

SEQ ID NO: 2427 - protein, 40 aa, Artificial Sequence
  Description of Artificial Sequence: Synthetic polypeptide
LEDSSGNLLGRNSFEVRVCACPGRHRRTEEENLRKKGEPH

SEQ ID NO: 2428 - protein, 40 aa, Artificial Sequence
  Description of Artificial Sequence: Synthetic polypeptide
GNLLGRNSFEVRVCACPGRHRRTEEENLRKKGEPHHELPP

SEQ ID NO: 2429 - protein, 40 aa, Artificial Sequence
  Description of Artificial Sequence: Synthetic polypeptide
TIITLEDSSGNLLGRNSFEVRVCACPGRDQRTEEENLRKK

SEQ ID NO: 2430 - protein, 40 aa, Artificial Sequence
  Description of Artificial Sequence: Synthetic polypeptide
ITLEDSSGNLLGRNSFEVRVCACPGRDQRTEEENLRKKGE

SEQ ID NO: 2431 - protein, 40 aa, Artificial Sequence
  Description of Artificial Sequence: Synthetic polypeptide
DSSGNLLGRNSFEVRVCACPGRDQRTEEENLRKKGEPHHE

SEQ ID NO: 2432 - protein, 40 aa, Artificial Sequence
  Description of Artificial Sequence: Synthetic polypeptide
NLLGRNSFEVRVCACPGRDQRTEEENLRKKGEPHHELPPG

SEQ ID NO: 2433 - protein, 40 aa, Artificial Sequence
  Description of Artificial Sequence: Synthetic polypeptide
NRRPILTIITLEDSSGNLLGRNSFEVRVCACPGRDWRTEE

SEQ ID NO: 2434 - protein, 40 aa, Artificial Sequence
  Description of Artificial Sequence: Synthetic polypeptide
RRPILTIITLEDSSGNLLGRNSFEVRVCACPGRDWRTEEE

SEQ ID NO: 2435 - protein, 40 aa, Artificial Sequence
  Description of Artificial Sequence: Synthetic polypeptide
RNSFEVRVCACPGRDWRTEEENLRKKGEPHHELPPGSTKR

SEQ ID NO: 2436 - protein, 40 aa, Artificial Sequence
  Description of Artificial Sequence: Synthetic polypeptide
NRRPILTIITLEDSSGNLLGRNSFEVRVCACPGRDRPTEE

SEQ ID NO: 2437 - protein, 40 aa, Artificial Sequence
  Description of Artificial Sequence: Synthetic polypeptide
NLLGRNSFEVRVCACPGRDRPTEEENLRKKGEPHHELPPG

SEQ ID NO: 2438 - protein, 40 aa, Artificial Sequence
  Description of Artificial Sequence: Synthetic polypeptide
LGRNSFEVRVCACPGRDRPTEEENLRKKGEPHHELPPGST

SEQ ID NO: 2439 - protein, 40 aa, Artificial Sequence
  Description of Artificial Sequence: Synthetic polypeptide
GRNSFEVRVCACPGRDRPTEEENLRKKGEPHHELPPGSTK

SEQ ID NO: 2440 - protein, 40 aa, Artificial Sequence
  Description of Artificial Sequence: Synthetic polypeptide
NSFEVRVCACPGRDRPTEEENLRKKGEPHHELPPGSTKRA

SEQ ID NO: 2441 - protein, 40 aa, Artificial Sequence
  Description of Artificial Sequence: Synthetic polypeptide
RDRPTEEENLRKKGEPHHELPPGSTKRALPNNTSSSPQPK

SEQ ID NO: 2442 - protein, 40 aa, Artificial Sequence
  Description of Artificial Sequence: Synthetic polypeptide
NRRPILTIITLEDSSGNLLGRNSFEVRVCACPGRDRRPEE

SEQ ID NO: 2443 - protein, 40 aa, Artificial Sequence
  Description of Artificial Sequence: Synthetic polypeptide
LTIITLEDSSGNLLGRNSFEVRVCACPGRDRRPEEENLRK

SEQ ID NO: 2444 - protein, 40 aa, Artificial Sequence
  Description of Artificial Sequence: Synthetic polypeptide
EDSSGNLLGRNSFEVRVCACPGRDRRPEEENLRKKGEPHH

SEQ ID NO: 2445 - protein, 40 aa, Artificial Sequence
  Description of Artificial Sequence: Synthetic polypeptide
GNLLGRNSFEVRVCACPGRDRRPEEENLRKKGEPHHELPP

SEQ ID NO: 2446 - protein, 40 aa, Artificial Sequence
  Description of Artificial Sequence: Synthetic polypeptide
SFEVRVCACPGRDRRPEEENLRKKGEPHHELPPGSTKRAL

SEQ ID NO: 2447 - protein, 40 aa, Artificial Sequence
  Description of Artificial Sequence: Synthetic polypeptide
ILTIITLEDSSGNLLGRNSFEVRVCACPGRDRRTKEENLR

SEQ ID NO: 2448 - protein, 40 aa, Artificial Sequence
  Description of Artificial Sequence: Synthetic polypeptide
LEDSSGNLLGRNSFEVRVCACPGRDRRTKEENLRKKGEPH

SEQ ID NO: 2449 - protein, 40 aa, Artificial Sequence
  Description of Artificial Sequence: Synthetic polypeptide
MNRRPILTIITLEDSSGNLLGRNSFEVRVCACPGRDRRTV

SEQ ID NO: 2450 - protein, 40 aa, Artificial Sequence
  Description of Artificial Sequence: Synthetic polypeptide
NRRPILTIITLEDSSGNLLGRNSFEVRVCACPGRDRRTVE

SEQ ID NO: 2451 - protein, 40 aa, Artificial Sequence
  Description of Artificial Sequence: Synthetic polypeptide
LTIITLEDSSGNLLGRNSFEVRVCACPGRDRRTVEENLRK

SEQ ID NO: 2452 - protein, 40 aa, Artificial Sequence
  Description of Artificial Sequence: Synthetic polypeptide
ITLEDSSGNLLGRNSFEVRVCACPGRDRRTVEENLRKKGE

SEQ ID NO: 2453 - protein, 40 aa, Artificial Sequence
  Description of Artificial Sequence: Synthetic polypeptide
NLLGRNSFEVRVCACPGRDRRTVEENLRKKGEPHHELPPG

SEQ ID NO: 2454 - protein, 40 aa, Artificial Sequence
  Description of Artificial Sequence: Synthetic polypeptide
RPILTIITLEDSSGNLLGRNSFEVRVCACPGRDRRTEGEN

SEQ ID NO: 2455 - protein, 40 aa, Artificial Sequence
  Description of Artificial Sequence: Synthetic polypeptide
SSGNLLGRNSFEVRVCACPGRDRRTEGENLRKKGEPHHEL

SEQ ID NO: 2456 - protein, 40 aa, Artificial Sequence
  Description of Artificial Sequence: Synthetic polypeptide
NRRPILTIITLEDSSGNLLGRNSFEVRVCACPGRDRRTEQ

SEQ ID NO: 2457 - protein, 40 aa, Artificial Sequence
  Description of Artificial Sequence: Synthetic polypeptide
RRPILTIITLEDSSGNLLGRNSFEVRVCACPGRDRRTEQE

SEQ ID NO: 2458 - protein, 40 aa, Artificial Sequence
  Description of Artificial Sequence: Synthetic polypeptide
IITLEDSSGNLLGRNSFEVRVCACPGRDRRTEQENLRKKG

SEQ ID NO: 2459 - protein, 40 aa, Artificial Sequence
  Description of Artificial Sequence: Synthetic polypeptide
ITLEDSSGNLLGRNSFEVRVCACPGRDRRTEQENLRKKGE

SEQ ID NO: 2460 - protein, 40 aa, Artificial Sequence
  Description of Artificial Sequence: Synthetic polypeptide
NLLGRNSFEVRVCACPGRDRRTEQENLRKKGEPHHELPPG

SEQ ID NO: 2461 - protein, 40 aa, Artificial Sequence
  Description of Artificial Sequence: Synthetic polypeptide
ALPNNTSSSPQPKKKPLDGEYFTLQFRGRERFEMFRELNE

SEQ ID NO: 2462 - protein, 40 aa, Artificial Sequence
  Description of Artificial Sequence: Synthetic polypeptide
FTLQFRGRERFEMFRELNEALELKDAQAGKEPGGSRAHSS

SEQ ID NO: 2463 - protein, 40 aa, Artificial Sequence
  Description of Artificial Sequence: Synthetic polypeptide
TSSSPQPKKKPLDGEYFTLQIRVRERFEMFRELNEALELK

SEQ ID NO: 2464 - protein, 40 aa, Artificial Sequence
  Description of Artificial Sequence: Synthetic polypeptide
PQPKKKPLDGEYFTLQIRVRERFEMFRELNEALELKDAQA

SEQ ID NO: 2465 - protein, 40 aa, Artificial Sequence
  Description of Artificial Sequence: Synthetic polypeptide
LDGEYFTLQIRVRERFEMFRELNEALELKDAQAGKEPGGS

SEQ ID NO: 2466 - protein, 40 aa, Artificial Sequence
  Description of Artificial Sequence: Synthetic polypeptide
DGEYFTLQIRVRERFEMFRELNEALELKDAQAGKEPGGSR

SEQ ID NO: 2467 - protein, 40 aa, Artificial Sequence
  Description of Artificial Sequence: Synthetic polypeptide
LQIRVRERFEMFRELNEALELKDAQAGKEPGGSRAHSSHL

SEQ ID NO: 2468 - protein, 40 aa, Artificial Sequence
  Description of Artificial Sequence: Synthetic polypeptide
NTSSSPQPKKKPLDGEYFTLQIRWRERFEMFRELNEALEL

SEQ ID NO: 2469 - protein, 40 aa, Artificial Sequence
  Description of Artificial Sequence: Synthetic polypeptide
SPQPKKKPLDGEYFTLQIRWRERFEMFRELNEALELKDAQ

SEQ ID NO: 2470 - protein, 40 aa, Artificial Sequence
  Description of Artificial Sequence: Synthetic polypeptide
KPLDGEYFTLQIRWRERFEMFRELNEALELKDAQAGKEPG

SEQ ID NO: 2471 - protein, 40 aa, Artificial Sequence
  Description of Artificial Sequence: Synthetic polypeptide
DGEYFTLQIRWRERFEMFRELNEALELKDAQAGKEPGGSR

SEQ ID NO: 2472 - protein, 40 aa, Artificial Sequence
  Description of Artificial Sequence: Synthetic polypeptide
ALPNNTSSSPQPKKKPLDGEYFTLQIRGREHFEMFRELNE

SEQ ID NO: 2473 - protein, 40 aa, Artificial Sequence
  Description of Artificial Sequence: Synthetic polypeptide
DGEYFTLQIRGREHFEMFRELNEALELKDAQAGKEPGGSR

SEQ ID NO: 2474 - protein, 40 aa, Artificial Sequence
  Description of Artificial Sequence: Synthetic polypeptide
GEYFTLQIRGRESFEMFRELNEALELKDAQAGKEPGGSRA

SEQ ID NO: 2475 - protein, 40 aa, Artificial Sequence
  Description of Artificial Sequence: Synthetic polypeptide
FTLQIRGRESFEMFRELNEALELKDAQAGKEPGGSRAHSS

SEQ ID NO: 2476 - protein, 40 aa, Artificial Sequence
  Description of Artificial Sequence: Synthetic polypeptide
TSSSPQPKKKPLDGEYFTLQIRGRERFEMFRELNEAFELK

SEQ ID NO: 2477 - protein, 40 aa, Artificial Sequence
  Description of Artificial Sequence: Synthetic polypeptide
PKKKPLDGEYFTLQIRGRERFEMFRELNEAFELKDAQAGK

SEQ ID NO: 2478 - protein, 40 aa, Artificial Sequence
  Description of Artificial Sequence: Synthetic polypeptide
TLQIRGRERFEMFRELNEAFELKDAQAGKEPGGSRAHSSH

SEQ ID NO: 2479 - protein, 40 aa, Artificial Sequence
  Description of Artificial Sequence: Synthetic polypeptide
NNTSSSPQPKKKPLDGEYFTLQIRGRERFEMFRELNEASE

SEQ ID NO: 2480 - protein, 40 aa, Artificial Sequence
  Description of Artificial Sequence: Synthetic polypeptide
LDGEYFTLQIRGRERFEMFRELNEASELKDAQAGKEPGGS

SEQ ID NO: 2481 - protein, 40 aa, Artificial Sequence
  Description of Artificial Sequence: Synthetic polypeptide
TLQIRGRERFEMFRELNEASELKDAQAGKEPGGSRAHSSH

SEQ ID NO: 2482 - protein, 40 aa, Artificial Sequence
  Description of Artificial Sequence: Synthetic polypeptide
IRGRERFEMFRELNEASELKDAQAGKEPGGSRAHSSHLKS

SEQ ID NO: 2483 - protein, 40 aa, Artificial Sequence
  Description of Artificial Sequence: Synthetic polypeptide
SPRVVLPVWLNFDGEPQPYPTLPPGTGRRIHSYRGNLWLF

SEQ ID NO: 2484 - protein, 40 aa, Artificial Sequence
  Description of Artificial Sequence: Synthetic polypeptide
LNFDGEPQPYPTLPPGTGRRIHSYRGNLWLFRDAGTHDGL

SEQ ID NO: 2485 - protein, 40 aa, Artificial Sequence
  Description of Artificial Sequence: Synthetic polypeptide
DGEPQPYPTLPPGTGRRIHSYRGNLWLFRDAGTHDGLLVN

SEQ ID NO: 2486 - protein, 40 aa, Artificial Sequence
  Description of Artificial Sequence: Synthetic polypeptide
PYPTLPPGTGRRIHSYRGNLWLFRDAGTHDGLLVNQTELF

SEQ ID NO: 2487 - protein, 40 aa, Artificial Sequence
  Description of Artificial Sequence: Synthetic polypeptide
GTGRRIHSYRGNLWLFRDAGTHDGLLVNQTELFVPSLNVD

SEQ ID NO: 2488 - protein, 40 aa, Artificial Sequence
  Description of Artificial Sequence: Synthetic polypeptide
TGRRIHSYRGNLWLFRDAGTHDGLLVNQTELFVPSLNVDG

SEQ ID NO: 2489 - protein, 40 aa, Artificial Sequence
  Description of Artificial Sequence: Synthetic polypeptide
IHSYRGNLWLFRDAGTHDGLLVNQTELFVPSLNVDGQPIF

SEQ ID NO: 2490 - protein, 40 aa, Artificial Sequence
  Description of Artificial Sequence: Synthetic polypeptide
SYRGNLWLFRDAGTHDGLLVNQTELFVPSLNVDGQPIFAN

SEQ ID NO: 2491 - protein, 40 aa, Artificial Sequence
  Description of Artificial Sequence: Synthetic polypeptide
GNLWLFRDAGTHDGLLVNQTELFVPSLNVDGQPIFANITL

SEQ ID NO: 2492 - protein, 40 aa, Artificial Sequence
  Description of Artificial Sequence: Synthetic polypeptide
VVLPVWLNFDGEPQPYPTLPPGTGRRIHSYRGHLCLFRDA

SEQ ID NO: 2493 - protein, 40 aa, Artificial Sequence
  Description of Artificial Sequence: Synthetic polypeptide
PTLPPGTGRRIHSYRGHLCLFRDAGTHDGLLVNQTELFVP

SEQ ID NO: 2494 - protein, 40 aa, Artificial Sequence
  Description of Artificial Sequence: Synthetic polypeptide
LPPGTGRRIHSYRGHLCLFRDAGTHDGLLVNQTELFVPSL

SEQ ID NO: 2495 - protein, 40 aa, Artificial Sequence
  Description of Artificial Sequence: Synthetic polypeptide
YRGHLCLFRDAGTHDGLLVNQTELFVPSLNVDGQPIFANI

SEQ ID NO: 2496 - protein, 40 aa, Artificial Sequence
  Description of Artificial Sequence: Synthetic polypeptide
DGEPQPYPTLPPGTGRRIHSYRGHLWPFRDAGTHDGLLVN

SEQ ID NO: 2497 - protein, 40 aa, Artificial Sequence
  Description of Artificial Sequence: Synthetic polypeptide
EPQPYPTLPPGTGRRIHSYRGHLWPFRDAGTHDGLLVNQT

SEQ ID NO: 2498 - protein, 40 aa, Artificial Sequence
  Description of Artificial Sequence: Synthetic polypeptide
GHLWPFRDAGTHDGLLVNQTELFVPSLNVDGQPIFANITL

SEQ ID NO: 2499 - protein, 40 aa, Artificial Sequence
  Description of Artificial Sequence: Synthetic polypeptide
PFRDAGTHDGLLVNQTELFVPSLNVDGQPIFANITLPVYT

SEQ ID NO: 2500 - protein, 40 aa, Artificial Sequence
  Description of Artificial Sequence: Synthetic polypeptide
RGHLWLFGDAGTHDGLLVNQTELFVPSLNVDGQPIFANIT

SEQ ID NO: 2501 - protein, 40 aa, Artificial Sequence
  Description of Artificial Sequence: Synthetic polypeptide
LWLFGDAGTHDGLLVNQTELFVPSLNVDGQPIFANITLPV

SEQ ID NO: 2502 - protein, 40 aa, Artificial Sequence
  Description of Artificial Sequence: Synthetic polypeptide
FGDAGTHDGLLVNQTELFVPSLNVDGQPIFANITLPVYTL

SEQ ID NO: 2503 - protein, 40 aa, Artificial Sequence
  Description of Artificial Sequence: Synthetic polypeptide
FDGEPQPYPTLPPGTGRRIHSYRGHLWLFRDAGTHDGHLV

SEQ ID NO: 2504 - protein, 40 aa, Artificial Sequence
  Description of Artificial Sequence: Synthetic polypeptide
SYRGHLWLFRDAGTHDGHLVNQTELFVPSLNVDGQPIFAN

SEQ ID NO: 2505 - protein, 40 aa, Artificial Sequence
  Description of Artificial Sequence: Synthetic polypeptide
DAGTHDGHLVNQTELFVPSLNVDGQPIFANITLPVYTLKE

SEQ ID NO: 2506 - protein, 40 aa, Artificial Sequence
  Description of Artificial Sequence: Synthetic polypeptide
PTLPPGTGRRIHSYRGHLWLFRDAGTHDGLLDNQTELFVP

SEQ ID NO: 2507 - protein, 40 aa, Artificial Sequence
  Description of Artificial Sequence: Synthetic polypeptide
LPPGTGRRIHSYRGHLWLFRDAGTHDGLLFNQTELFVPSL

SEQ ID NO: 2508 - protein, 40 aa, Artificial Sequence
  Description of Artificial Sequence: Synthetic polypeptide
RGHLWLFRDAGTHDGLLFNQTELFVPSLNVDGQPIFANIT

SEQ ID NO: 2509 - protein, 40 aa, Artificial Sequence
  Description of Artificial Sequence: Synthetic polypeptide
GHLWLFRDAGTHDGLLFNQTELFVPSLNVDGQPIFANITL

SEQ ID NO: 2510 - protein, 40 aa, Artificial Sequence
  Description of Artificial Sequence: Synthetic polypeptide
WLFRDAGTHDGLLFNQTELFVPSLNVDGQPIFANITLPVY

SEQ ID NO: 2511 - protein, 40 aa, Artificial Sequence
  Description of Artificial Sequence: Synthetic polypeptide
PQPYPTLPPGTGRRIHSYRGHLWLFRDAGTHDGLLVYQTE

SEQ ID NO: 2512 - protein, 40 aa, Artificial Sequence
  Description of Artificial Sequence: Synthetic polypeptide
FRDAGTHDGLLVYQTELFVPSLNVDGQPIFANITLPVYTL

SEQ ID NO: 2513 - protein, 40 aa, Artificial Sequence
  Description of Artificial Sequence: Synthetic polypeptide
RDAGTHDGLLVYQTELFVPSLNVDGQPIFANITLPVYTLK

SEQ ID NO: 2514 - protein, 40 aa, Artificial Sequence
  Description of Artificial Sequence: Synthetic polypeptide
RIHSYRGHLWLFRDAGTHDGLLVNQTELVVPSLNVDGQPI

SEQ ID NO: 2515 - protein, 40 aa, Artificial Sequence
  Description of Artificial Sequence: Synthetic polypeptide
FRDAGTHDGLLVNQTELVVPSLNVDGQPIFANITLPVYTL

SEQ ID NO: 2516 - protein, 40 aa, Artificial Sequence
  Description of Artificial Sequence: Synthetic polypeptide
GLLVNQTELVVPSLNVDGQPIFANITLPVYTLKERCLQVV

SEQ ID NO: 2517 - protein, 40 aa, Artificial Sequence
  Description of Artificial Sequence: Synthetic polypeptide
QTELVVPSLNVDGQPIFANITLPVYTLKERCLQVVRSLVK

SEQ ID NO: 2518 - protein, 40 aa, Artificial Sequence
  Description of Artificial Sequence: Synthetic polypeptide
QTELFVPSLNVDGQPIFANFTLPVYTLKERCLQVVRSLVK

SEQ ID NO: 2519 - protein, 40 aa, Artificial Sequence
  Description of Artificial Sequence: Synthetic polypeptide
VPSLNVDGQPIFANFTLPVYTLKERCLQVVRSLVKPENYR

SEQ ID NO: 2520 - protein, 40 aa, Artificial Sequence
  Description of Artificial Sequence: Synthetic polypeptide
NVDGQPIFANFTLPVYTLKERCLQVVRSLVKPENYRRLDI

SEQ ID NO: 2521 - protein, 40 aa, Artificial Sequence
  Description of Artificial Sequence: Synthetic polypeptide
FTLPVYTLKERCLQVVRSLVKPENYRRLDIVRSLYEDLED

SEQ ID NO: 2522 - protein, 40 aa, Artificial Sequence
  Description of Artificial Sequence: Synthetic polypeptide
RGHLWLFRDAGTHDGLLVNQTELFVPSLNVDGQPIFANNT

SEQ ID NO: 2523 - protein, 40 aa, Artificial Sequence
  Description of Artificial Sequence: Synthetic polypeptide
FRDAGTHDGLLVNQTELFVPSLNVDGQPIFANNTLPVYTL

SEQ ID NO: 2524 - protein, 40 aa, Artificial Sequence
  Description of Artificial Sequence: Synthetic polypeptide
AGTHDGLLVNQTELFVPSLNVDGQPIFANNTLPVYTLKER

SEQ ID NO: 2525 - protein, 40 aa, Artificial Sequence
  Description of Artificial Sequence: Synthetic polypeptide
QTELFVPSLNVDGQPIFANNTLPVYTLKERCLQVVRSLVK

SEQ ID NO: 2526 - protein, 40 aa, Artificial Sequence
  Description of Artificial Sequence: Synthetic polypeptide
ELFVPSLNVDGQPIFANNTLPVYTLKERCLQVVRSLVKPE

SEQ ID NO: 2527 - protein, 40 aa, Artificial Sequence
  Description of Artificial Sequence: Synthetic polypeptide
FVPSLNVDGQPIFANNTLPVYTLKERCLQVVRSLVKPENY

SEQ ID NO: 2528 - protein, 40 aa, Artificial Sequence
  Description of Artificial Sequence: Synthetic polypeptide
LFRDAGTHDGLLVNQTELFVPSLNVDGQPIFANITPPVYT

SEQ ID NO: 2529 - protein, 40 aa, Artificial Sequence
  Description of Artificial Sequence: Synthetic polypeptide
SLNVDGQPIFANITPPVYTLKERCLQVVRSLVKPENYRRL

SEQ ID NO: 2530 - protein, 40 aa, Artificial Sequence
  Description of Artificial Sequence: Synthetic polypeptide
FRDAGTHDGLLVNQTELFVPSLNVDGQPIFANITLPVYTR

SEQ ID NO: 2531 - protein, 40 aa, Artificial Sequence
  Description of Artificial Sequence: Synthetic polypeptide
FANITLPVYTRKERCLQVVRSLVKPENYRRLDIVRSLYED

SEQ ID NO: 2532 - protein, 40 aa, Artificial Sequence
  Description of Artificial Sequence: Synthetic polypeptide
NITLPVYTRKERCLQVVRSLVKPENYRRLDIVRSLYEDLE

SEQ ID NO: 2533 - protein, 40 aa, Artificial Sequence
  Description of Artificial Sequence: Synthetic polypeptide
RDAGTHDGLLVNQTELFVPSLNVDGQPIFANITLPVYTVK

SEQ ID NO: 2534 - protein, 40 aa, Artificial Sequence
  Description of Artificial Sequence: Synthetic polypeptide
TELFVPSLNVDGQPIFANITLPVYTVKERCLQVVRSLVKP

SEQ ID NO: 2535 - protein, 40 aa, Artificial Sequence
  Description of Artificial Sequence: Synthetic polypeptide
FVPSLNVDGQPIFANITLPVYTVKERCLQVVRSLVKPENY

SEQ ID NO: 2536 - protein, 40 aa, Artificial Sequence
  Description of Artificial Sequence: Synthetic polypeptide
VPSLNVDGQPIFANITLPVYTVKERCLQVVRSLVKPENYR

SEQ ID NO: 2537 - protein, 40 aa, Artificial Sequence
  Description of Artificial Sequence: Synthetic polypeptide
IFANITLPVYTVKERCLQVVRSLVKPENYRRLDIVRSLYE

SEQ ID NO: 2538 - protein, 40 aa, Artificial Sequence
  Description of Artificial Sequence: Synthetic polypeptide
TLPVYTVKERCLQVVRSLVKPENYRRLDIVRSLYEDLEDH

SEQ ID NO: 2539 - protein, 40 aa, Artificial Sequence
  Description of Artificial Sequence: Synthetic polypeptide
VDGQPIFANITLPVYTLKEQCLQVVRSLVKPENYRRLDIV

SEQ ID NO: 2540 - protein, 40 aa, Artificial Sequence
  Description of Artificial Sequence: Synthetic polypeptide
RLQVVRSLVKPENYRRLDIVRSLYEDLEDHPNVQKDLERL

SEQ ID NO: 2541 - protein, 40 aa, Artificial Sequence
  Description of Artificial Sequence: Synthetic polypeptide
KERCLQDVRSLVKPENYRRLDIVRSLYEDLEDHPNVQKDL

SEQ ID NO: 2542 - protein, 40 aa, Artificial Sequence
  Description of Artificial Sequence: Synthetic polypeptide
RCLQDVRSLVKPENYRRLDIVRSLYEDLEDHPNVQKDLER

SEQ ID NO: 2543 - protein, 40 aa, Artificial Sequence
  Description of Artificial Sequence: Synthetic polypeptide
NVDGQPIFANITLPVYTLKERCLQVVRSLVKPENYRRPDI

SEQ ID NO: 2544 - protein, 40 aa, Artificial Sequence
  Description of Artificial Sequence: Synthetic polypeptide
ENYRRPDIVRSLYEDLEDHPNVQKDLERLTQERIAHQRMG

SEQ ID NO: 2545 - protein, 40 aa, Artificial Sequence
  Description of Artificial Sequence: Synthetic polypeptide
LVKPENYRRLDIVRSPYEDLEDHPNVQKDLERLTQERIAH

SEQ ID NO: 2546 - protein, 40 aa, Artificial Sequence
  Description of Artificial Sequence: Synthetic polypeptide
LPVYTLKERCLQVVRSLVKPENYRRLDIVRSLYEDPEDHP

SEQ ID NO: 2547 - protein, 40 aa, Artificial Sequence
  Description of Artificial Sequence: Synthetic polypeptide
RCLQVVRSLVKPENYRRLDIVRSLYEDPEDHPNVQKDLER

SEQ ID NO: 2548 - protein, 40 aa, Artificial Sequence
  Description of Artificial Sequence: Synthetic polypeptide
RPVLRSVNSREPSQVIFCNGSPRVVLPVWLNFDGEPQPYP

SEQ ID NO: 2549 - protein, 40 aa, Artificial Sequence
  Description of Artificial Sequence: Synthetic polypeptide
PSQVIFCNGSPRVVLPVWLNFDGEPQPYPTLPPGTGRRIH

SEQ ID NO: 2550 - protein, 40 aa, Artificial Sequence
  Description of Artificial Sequence: Synthetic polypeptide
EELGAEEEMEAGRPRPVLRSVNSREPSQVIFCNRRPRVVL

SEQ ID NO: 2551 - protein, 40 aa, Artificial Sequence
  Description of Artificial Sequence: Synthetic polypeptide
GRPRPVLRSVNSREPSQVIFCNRSPPVVLPVWLNFDGEPQ

SEQ ID NO: 2552 - protein, 40 aa, Artificial Sequence
  Description of Artificial Sequence: Synthetic polypeptide
PVLRSVNSREPSQVIFCNRSPPVVLPVWLNFDGEPQPYPT

SEQ ID NO: 2553 - protein, 40 aa, Artificial Sequence
  Description of Artificial Sequence: Synthetic polypeptide
EEEMEAGRPRPVLRSVNSREPSQVIFCNRSPRVVLPVWHN

SEQ ID NO: 2554 - protein, 40 aa, Artificial Sequence
  Description of Artificial Sequence: Synthetic polypeptide
QQQQKGGGGSQINSTRYKTELYRPFEESGTCKYGEKCQFA

SEQ ID NO: 2555 - protein, 40 aa, Artificial Sequence
  Description of Artificial Sequence: Synthetic polypeptide
HIIETKFEMIKLIDIARQTAQGMDYLDAKSIIHRDLKSNN

SEQ ID NO: 2556 - protein, 40 aa, Artificial Sequence
  Description of Artificial Sequence: Synthetic polypeptide
DIARQTAQGMDYLDAKSIIHRDLKSNNIFLHEDLTVKIGD

SEQ ID NO: 2557 - protein, 40 aa, Artificial Sequence
  Description of Artificial Sequence: Synthetic polypeptide
IKLIDIARQTAQGMDYLHAKSIIHKDLKSNNIFLHEDLTV

SEQ ID NO: 2558 - protein, 40 aa, Artificial Sequence
  Description of Artificial Sequence: Synthetic polypeptide
YLHAKSIIHKDLKSNNIFLHEDLTVKIGDFGLATVKSRWS

SEQ ID NO: 2559 - protein, 40 aa, Artificial Sequence
  Description of Artificial Sequence: Synthetic polypeptide
LHAKSIIHKDLKSNNIFLHEDLTVKIGDFGLATVKSRWSG

SEQ ID NO: 2560 - protein, 40 aa, Artificial Sequence
  Description of Artificial Sequence: Synthetic polypeptide
HAKSIIHKDLKSNNIFLHEDLTVKIGDFGLATVKSRWSGS

SEQ ID NO: 2561 - protein, 40 aa, Artificial Sequence
  Description of Artificial Sequence: Synthetic polypeptide
IHKDLKSNNIFLHEDLTVKIGDFGLATVKSRWSGSHQFEQ

SEQ ID NO: 2562 - protein, 40 aa, Artificial Sequence
  Description of Artificial Sequence: Synthetic polypeptide
HKDLKSNNIFLHEDLTVKIGDFGLATVKSRWSGSHQFEQL

SEQ ID NO: 2563 - protein, 40 aa, Artificial Sequence
  Description of Artificial Sequence: Synthetic polypeptide
ETKFEMIKLIDIARQTAQGMDYLHAKSIIHRDLKSNIIFL

SEQ ID NO: 2564 - protein, 40 aa, Artificial Sequence
  Description of Artificial Sequence: Synthetic polypeptide
RDLKSNIIFLHEDLTVKIGDFGLATVKSRWSGSHQFEQLS

SEQ ID NO: 2565 - protein, 40 aa, Artificial Sequence
  Description of Artificial Sequence: Synthetic polypeptide
IIHRDLKSNNIFLHEDLTVKIGGFGLATVKSRWSGSHQFE

SEQ ID NO: 2566 - protein, 40 aa, Artificial Sequence
  Description of Artificial Sequence: Synthetic polypeptide
HRDLKSNNIFLHEDLTVKIGGFGLATVKSRWSGSHQFEQL

SEQ ID NO: 2567 - protein, 40 aa, Artificial Sequence
  Description of Artificial Sequence: Synthetic polypeptide
DLKSNNIFLHEDLTVKIGGFGLATVKSRWSGSHQFEQLSG

SEQ ID NO: 2568 - protein, 40 aa, Artificial Sequence
  Description of Artificial Sequence: Synthetic polypeptide
KSNNIFLHEDLTVKIGGFGLATVKSRWSGSHQFEQLSGSI

SEQ ID NO: 2569 - protein, 40 aa, Artificial Sequence
  Description of Artificial Sequence: Synthetic polypeptide
YLHAKSIIHRDLKSNNIFLHEDLTVKIGNFGLATVKSRWS

SEQ ID NO: 2570 - protein, 40 aa, Artificial Sequence
  Description of Artificial Sequence: Synthetic polypeptide
NIFLHEDLTVKIGNFGLATVKSRWSGSHQFEQLSGSILWM

SEQ ID NO: 2571 - protein, 40 aa, Artificial Sequence
  Description of Artificial Sequence: Synthetic polypeptide
HAKSIIHRDLKSNNIFLHEDLTVKIGDFDLATVKSRWSGS

SEQ ID NO: 2572 - protein, 40 aa, Artificial Sequence
  Description of Artificial Sequence: Synthetic polypeptide
YLHAKSIIHRDLKSNNIFLHEDLTVKIGDFSLATVKSRWS

SEQ ID NO: 2573 - protein, 40 aa, Artificial Sequence
  Description of Artificial Sequence: Synthetic polypeptide
LHAKSIIHRDLKSNNIFLHEDLTVKIGDFSLATVKSRWSG

SEQ ID NO: 2574 - protein, 40 aa, Artificial Sequence
  Description of Artificial Sequence: Synthetic polypeptide
DLKSNNIFLHEDLTVKIGDFSLATVKSRWSGSHQFEQLSG

SEQ ID NO: 2575 - protein, 40 aa, Artificial Sequence
  Description of Artificial Sequence: Synthetic polypeptide
LKSNNIFLHEDLTVKIGDFSLATVKSRWSGSHQFEQLSGS

SEQ ID NO: 2576 - protein, 40 aa, Artificial Sequence
  Description of Artificial Sequence: Synthetic polypeptide
YLHAKSIIHRDLKSNNIFLHEDLTVKIGDFGQATVKSRWS

SEQ ID NO: 2577 - protein, 40 aa, Artificial Sequence
  Description of Artificial Sequence: Synthetic polypeptide
HAKSIIHRDLKSNNIFLHEDLTVKIGDFGQATVKSRWSGS

SEQ ID NO: 2578 - protein, 40 aa, Artificial Sequence
  Description of Artificial Sequence: Synthetic polypeptide
HRDLKSNNIFLHEDLTVKIGDFGQATVKSRWSGSHQFEQL

SEQ ID NO: 2579 - protein, 40 aa, Artificial Sequence
  Description of Artificial Sequence: Synthetic polypeptide
NIFLHEDLTVKIGDFGQATVKSRWSGSHQFEQLSGSILWM

SEQ ID NO: 2580 - protein, 40 aa, Artificial Sequence
  Description of Artificial Sequence: Synthetic polypeptide
YLHAKSIIHRDLKSNNIFLHEDLTVKIGDFGVATVKSRWS

SEQ ID NO: 2581 - protein, 40 aa, Artificial Sequence
  Description of Artificial Sequence: Synthetic polypeptide
LHAKSIIHRDLKSNNIFLHEDLTVKIGDFGVATVKSRWSG

SEQ ID NO: 2582 - protein, 40 aa, Artificial Sequence
  Description of Artificial Sequence: Synthetic polypeptide
DLKSNNIFLHEDLTVKIGDFGVATVKSRWSGSHQFEQLSG

SEQ ID NO: 2583 - protein, 40 aa, Artificial Sequence
  Description of Artificial Sequence: Synthetic polypeptide
LKSNNIFLHEDLTVKIGDFGVATVKSRWSGSHQFEQLSGS

SEQ ID NO: 2584 - protein, 40 aa, Artificial Sequence
  Description of Artificial Sequence: Synthetic polypeptide
HAKSIIHRDLKSNNIFLHEDLTVKIGDFGLATEKSRWSGS

SEQ ID NO: 2585 - protein, 40 aa, Artificial Sequence
  Description of Artificial Sequence: Synthetic polypeptide
DLKSNNIFLHEDLTVKIGDFGLATEKSRWSGSHQFEQLSG

SEQ ID NO: 2586 - protein, 40 aa, Artificial Sequence
  Description of Artificial Sequence: Synthetic polypeptide
NIFLHEDLTVKIGDFGLATEKSRWSGSHQFEQLSGSILWM

SEQ ID NO: 2587 - protein, 40 aa, Artificial Sequence
  Description of Artificial Sequence: Synthetic polypeptide
KVFFIQACQGDNYQKGIPVETDSEEQPYLEMDLSSPQTRY

SEQ ID NO: 2588 - protein, 40 aa, Artificial Sequence
  Description of Artificial Sequence: Synthetic polypeptide
KVFFIQACQGDNYQGGIPVETDSEEQPYLEMDLSSPQTRY

SEQ ID NO: 2589 - protein, 40 aa, Artificial Sequence
  Description of Artificial Sequence: Synthetic polypeptide
RERIATYTLFSHAVSSNGNAVEDPMEILITVTDQNNNKPE

SEQ ID NO: 2590 - protein, 40 aa, Artificial Sequence
  Description of Artificial Sequence: Synthetic polypeptide
SNGNAVEDPMEILITVTDQNNNKPEFTQEVFKGSVMEGAL

SEQ ID NO: 2591 - protein, 40 aa, Artificial Sequence
  Description of Artificial Sequence: Synthetic polypeptide
MEVTATDAGDDVNTYNAAIAYTILSQDPELPDKNMFTINR

SEQ ID NO: 2592 - protein, 40 aa, Artificial Sequence
  Description of Artificial Sequence: Synthetic polypeptide
HRDLKPENVLLSSQEEDCLIKITDFGHSKILGETSLRRTL

SEQ ID NO: 2593 - protein, 40 aa, Artificial Sequence
  Description of Artificial Sequence: Synthetic polypeptide
RDLKPENVLLSSQEEDCLIKITDFGHSKILGETSLRRTLC

SEQ ID NO: 2594 - protein, 40 aa, Artificial Sequence
  Description of Artificial Sequence: Synthetic polypeptide
KITDFGHSKILGETSLRRTLCGTPTYLAPEVLVSVGTAGY

SEQ ID NO: 2595 - protein, 40 aa, Artificial Sequence
  Description of Artificial Sequence: Synthetic polypeptide
KILGETSLRRTLCGTPTYLAPEVLVSVGTAGYNRAVDCWS

SEQ ID NO: 2596 - protein, 40 aa, Artificial Sequence
  Description of Artificial Sequence: Synthetic polypeptide
ETSLRRTLCGTPTYLAPEVLVSVGTAGYNRAVDCWSLGVI

SEQ ID NO: 2597 - protein, 40 aa, Artificial Sequence
  Description of Artificial Sequence: Synthetic polypeptide
SQEEDCLIKITDFGHSKILGETSLMRTLCGTLTYLAPEVL

SEQ ID NO: 2598 - protein, 40 aa, Artificial Sequence
  Description of Artificial Sequence: Synthetic polypeptide
IKITDFGHSKILGETSLMRTLCGTLTYLAPEVLVSVGTAG

SEQ ID NO: 2599 - protein, 40 aa, Artificial Sequence
  Description of Artificial Sequence: Synthetic polypeptide
KITDFGHSKILGETSLMRTLCGTLTYLAPEVLVSVGTAGY

SEQ ID NO: 2600 - protein, 40 aa, Artificial Sequence
  Description of Artificial Sequence: Synthetic polypeptide
GETSLMRTLCGTLTYLAPEVLVSVGTAGYNRAVDCWSLGV

SEQ ID NO: 2601 - protein, 40 aa, Artificial Sequence
  Description of Artificial Sequence: Synthetic polypeptide
SSQEEDCLIKITDFGHSKILGETSLMRTLCGTYTYLAPEV

SEQ ID NO: 2602 - protein, 40 aa, Artificial Sequence
  Description of Artificial Sequence: Synthetic polypeptide
IKITDFGHSKILGETSLMRTLCGTYTYLAPEVLVSVGTAG

SEQ ID NO: 2603 - protein, 40 aa, Artificial Sequence
  Description of Artificial Sequence: Synthetic polypeptide
ITDFGHSKILGETSLMRTLCGTYTYLAPEVLVSVGTAGYN

SEQ ID NO: 2604 - protein, 40 aa, Artificial Sequence
  Description of Artificial Sequence: Synthetic polypeptide
TSLMRTLCGTYTYLAPEVLVSVGTAGYNRAVDCWSLGVIL

SEQ ID NO: 2605 - protein, 40 aa, Artificial Sequence
  Description of Artificial Sequence: Synthetic polypeptide
SSQEEDCLIKITDFGHSKILGETSLMRTLCGTPHYLAPEV

SEQ ID NO: 2606 - protein, 40 aa, Artificial Sequence
  Description of Artificial Sequence: Synthetic polypeptide
ITDFGHSKILGETSLMRTLCGTPHYLAPEVLVSVGTAGYN

SEQ ID NO: 2607 - protein, 40 aa, Artificial Sequence
  Description of Artificial Sequence: Synthetic polypeptide
GETSLMRTLCGTPTYLAPEVLVSVGTAGYNRAVDCWSLGF

SEQ ID NO: 2608 - protein, 40 aa, Artificial Sequence
  Description of Artificial Sequence: Synthetic polypeptide
TPTYLAPEVLVSVGTAGYNRAVDCWSLGFILFICLSGYPP

SEQ ID NO: 2609 - protein, 40 aa, Artificial Sequence
  Description of Artificial Sequence: Synthetic polypeptide
GVILFICLSGYPPFSEHRTQVSLKDQITSGKYNFIPEVGA

SEQ ID NO: 2610 - protein, 40 aa, Artificial Sequence
  Description of Artificial Sequence: Synthetic polypeptide
NQESKLIILASGGPQALVNIMRTYTFEKLLWTTSRVLKVL

SEQ ID NO: 2611 - protein, 40 aa, Artificial Sequence
  Description of Artificial Sequence: Synthetic polypeptide
IILASGGPQALVNIMRTYTFEKLLWTTSRVLKVLSVCSSN

SEQ ID NO: 2612 - protein, 40 aa, Artificial Sequence
  Description of Artificial Sequence: Synthetic polypeptide
ILASGGPQALVNIMRTYTFEKLLWTTSRVLKVLSVCSSNK

SEQ ID NO: 2613 - protein, 40 aa, Artificial Sequence
  Description of Artificial Sequence: Synthetic polypeptide
GGPQALVNIMRTYTFEKLLWTTSRVLKVLSVCSSNKPAIV

SEQ ID NO: 2614 - protein, 40 aa, Artificial Sequence
  Description of Artificial Sequence: Synthetic polypeptide
ALVNIMRTYTFEKLLWTTSRVLKVLSVCSSNKPAIVEAGG

SEQ ID NO: 2615 - protein, 40 aa, Artificial Sequence
  Description of Artificial Sequence: Synthetic polypeptide
IMRTYTFEKLLWTTSRVLKVLSVCSSNKPAIVEAGGMQAL

SEQ ID NO: 2616 - protein, 40 aa, Artificial Sequence
  Description of Artificial Sequence: Synthetic polypeptide
QESKLIILASGGPQALVNIMRTYTYKKLLWTTSRVLKVLS

SEQ ID NO: 2617 - protein, 40 aa, Artificial Sequence
  Description of Artificial Sequence: Synthetic polypeptide
IILASGGPQALVNIMRTYTYKKLLWTTSRVLKVLSVCSSN

SEQ ID NO: 2618 - protein, 40 aa, Artificial Sequence
  Description of Artificial Sequence: Synthetic polypeptide
GPQALVNIMRTYTYKKLLWTTSRVLKVLSVCSSNKPAIVE

SEQ ID NO: 2619 - protein, 40 aa, Artificial Sequence
  Description of Artificial Sequence: Synthetic polypeptide
DCLQILAYGNQESKLIILASGGPQALVNIMRTYTYETLLW

SEQ ID NO: 2620 - protein, 40 aa, Artificial Sequence
  Description of Artificial Sequence: Synthetic polypeptide
SGGPQALVNIMRTYTYETLLWTTSRVLKVLSVCSSNKPAI

SEQ ID NO: 2621 - protein, 40 aa, Artificial Sequence
  Description of Artificial Sequence: Synthetic polypeptide
GGPQALVNIMRTYTYETLLWTTSRVLKVLSVCSSNKPAIV

SEQ ID NO: 2622 - protein, 40 aa, Artificial Sequence
  Description of Artificial Sequence: Synthetic polypeptide
GPQALVNIMRTYTYETLLWTTSRVLKVLSVCSSNKPAIVE

SEQ ID NO: 2623 - protein, 40 aa, Artificial Sequence
  Description of Artificial Sequence: Synthetic polypeptide
ALVNIMRTYTYETLLWTTSRVLKVLSVCSSNKPAIVEAGG

SEQ ID NO: 2624 - protein, 40 aa, Artificial Sequence
  Description of Artificial Sequence: Synthetic polypeptide
GNLSDAATKQEGMEGLLGTLVQLLGSDDINVVTCAAGILS

SEQ ID NO: 2625 - protein, 40 aa, Artificial Sequence
  Description of Artificial Sequence: Synthetic polypeptide
EGMEGLLGTLVQLLGSDDINVVTCAAGILSDLTCNNYKNK

SEQ ID NO: 2626 - protein, 40 aa, Artificial Sequence
  Description of Artificial Sequence: Synthetic polypeptide
GMEGLLGTLVQLLGSDDINVVTCAAGILSDLTCNNYKNKM

SEQ ID NO: 2627 - protein, 40 aa, Artificial Sequence
  Description of Artificial Sequence: Synthetic polypeptide
MEGLLGTLVQLLGSDDINVVTCAAGILSDLTCNNYKNKMM

SEQ ID NO: 2628 - protein, 40 aa, Artificial Sequence
  Description of Artificial Sequence: Synthetic polypeptide
EGLLGTLVQLLGSDDINVVTCAAGILSDLTCNNYKNKMMV

SEQ ID NO: 2629 - protein, 40 aa, Artificial Sequence
  Description of Artificial Sequence: Synthetic polypeptide
QLLGSDDINVVTCAAGILSDLTCNNYKNKMMVCQVGGIEA

SEQ ID NO: 2630 - protein, 40 aa, Artificial Sequence
  Description of Artificial Sequence: Synthetic polypeptide
NFDLPSDIEEYVHCIGRTGRVGNLGLATSFFNERNINITK

SEQ ID NO: 2631 - protein, 40 aa, Artificial Sequence
  Description of Artificial Sequence: Synthetic polypeptide
INFDLPSDIEEYVHRIGRAGRVGNLGLATSFFNERNINIT

SEQ ID NO: 2632 - protein, 40 aa, Artificial Sequence
  Description of Artificial Sequence: Synthetic polypeptide
GRAGRVGNLGLATSFFNERNINITKDLLDLLVEAKQEVPS

SEQ ID NO: 2633 - protein, 40 aa, Artificial Sequence
  Description of Artificial Sequence: Synthetic polypeptide
ISNVKHVINFDLPSDIEEYVHRIGRMGRVGNLGLATSFFN

SEQ ID NO: 2634 - protein, 40 aa, Artificial Sequence
  Description of Artificial Sequence: Synthetic polypeptide
GRMGRVGNLGLATSFFNERNINITKDLLDLLVEAKQEVPS

SEQ ID NO: 2635 - protein, 40 aa, Artificial Sequence
  Description of Artificial Sequence: Synthetic polypeptide
SGFENFEKKINYRFKNKAYLLQAFTHASYHYNTITDCYQS

SEQ ID NO: 2636 - protein, 40 aa, Artificial Sequence
  Description of Artificial Sequence: Synthetic polypeptide
FENFEKKINYRFKNKAYLLQAFTHASYHYNTITDCYQSLE

SEQ ID NO: 2637 - protein, 40 aa, Artificial Sequence
  Description of Artificial Sequence: Synthetic polypeptide
DDFVQFQLEKNEMQGMDSELRRSEEDEEKEEDIEVPKAMR

SEQ ID NO: 2638 - protein, 40 aa, Artificial Sequence
  Description of Artificial Sequence: Synthetic polypeptide
VPKAMRDIFESLAGAIYMDSGMSLETVWQVYYPMMRPLIE

SEQ ID NO: 2639 - protein, 40 aa, Artificial Sequence
  Description of Artificial Sequence: Synthetic polypeptide
AMGVIFESLAGAIYMDSGMSLETVWQVYYPMMRPLIEKFS

SEQ ID NO: 2640 - protein, 40 aa, Artificial Sequence
  Description of Artificial Sequence: Synthetic polypeptide
NTVERIPLENLQIIKGNMYYENSYALAVLSNYDANKTGLK

SEQ ID NO: 2641 - protein, 40 aa, Artificial Sequence
  Description of Artificial Sequence: Synthetic polypeptide
RIPLENLQIIKGNMYYENSYALAVLSNYDANKTGLKELPM

SEQ ID NO: 2642 - protein, 40 aa, Artificial Sequence
  Description of Artificial Sequence: Synthetic polypeptide
QIIKGNMYYENSYALAVLSNYDANKTGLKELPMRNLQEIL

SEQ ID NO: 2643 - protein, 40 aa, Artificial Sequence
  Description of Artificial Sequence: Synthetic polypeptide
IIKGNMYYENSYALAVLSNYDANKTGLKELPMRNLQEILH

SEQ ID NO: 2644 - protein, 40 aa, Artificial Sequence
  Description of Artificial Sequence: Synthetic polypeptide
KGNMYYENSYALAVLSNYDANKTGLKELPMRNLQEILHGA

SEQ ID NO: 2645 - protein, 40 aa, Artificial Sequence
  Description of Artificial Sequence: Synthetic polypeptide
GTTCVKKCPRNYVVTDHGSCVRACGADSYEMEEDGVRKCK

SEQ ID NO: 2646 - protein, 40 aa, Artificial Sequence
  Description of Artificial Sequence: Synthetic polypeptide
GVTCVKKCPRNYVVTDHGSCVRACGADSYEMEEDGVRKCK

SEQ ID NO: 2647 - protein, 40 aa, Artificial Sequence
  Description of Artificial Sequence: Synthetic polypeptide
EAPNQALLRILKETEFKKIKVLCSGAFGTVYKGLWIPEGE

SEQ ID NO: 2648 - protein, 40 aa, Artificial Sequence
  Description of Artificial Sequence: Synthetic polypeptide
NQALLRILKETEFKKIKVLCSGAFGTVYKGLWIPEGEKVK

SEQ ID NO: 2649 - protein, 40 aa, Artificial Sequence
  Description of Artificial Sequence: Synthetic polypeptide
LKETEFKKIKVLDSGAFGTVYKGLWIPEGEKVKIPVAIKE

SEQ ID NO: 2650 - protein, 40 aa, Artificial Sequence
  Description of Artificial Sequence: Synthetic polypeptide
LVEPLTPSGEAPNQALLRILKETEFKKIKVLGSGAFSTVY

SEQ ID NO: 2651 - protein, 40 aa, Artificial Sequence
  Description of Artificial Sequence: Synthetic polypeptide
SGEAPNQALLRILKETEFKKIKVLGSGAFSTVYKGLWIPE

SEQ ID NO: 2652 - protein, 40 aa, Artificial Sequence
  Description of Artificial Sequence: Synthetic polypeptide
EAPNQALLRILKETEFKKIKVLGSGAFSTVYKGLWIPEGE

SEQ ID NO: 2653 - protein, 40 aa, Artificial Sequence
  Description of Artificial Sequence: Synthetic polypeptide
GAFGTVYKGLWIPEGEKVKIPVAIKELREATSPKANKENL

SEQ ID NO: 2654 - protein, 40 aa, Artificial Sequence
  Description of Artificial Sequence: Synthetic polypeptide
WIPEGEKVKIPVAIKELREATSPKANKENLDEAYVMASVD

SEQ ID NO: 2655 - protein, 40 aa, Artificial Sequence
  Description of Artificial Sequence: Synthetic polypeptide
IPEGEKVKIPVAIKELREATSPKANKENLDEAYVMASVDN

SEQ ID NO: 2656 - protein, 40 aa, Artificial Sequence
  Description of Artificial Sequence: Synthetic polypeptide
YISYLNSVHFFRPKCLRTAVYHEILIGYLEYVKKLGYTTG

SEQ ID NO: 2657 - protein, 40 aa, Artificial Sequence
  Description of Artificial Sequence: Synthetic polypeptide
RRVYISYLDIVHFFRPKCLRTAVYHEILIGYLEYVKKLGY

SEQ ID NO: 2658 - protein, 40 aa, Artificial Sequence
  Description of Artificial Sequence: Synthetic polypeptide
LDIVHFFRPKCLRTAVYHEILIGYLEYVKKLGYTTGHIWA

SEQ ID NO: 2659 - protein, 40 aa, Artificial Sequence
  Description of Artificial Sequence: Synthetic polypeptide
CPPPNQRRVYISYLDSVHFFRPKCLRTAVCHEILIGYLEY

SEQ ID NO: 2660 - protein, 40 aa, Artificial Sequence
  Description of Artificial Sequence: Synthetic polypeptide
FFRPKCLRTAVDHEILIGYLEYVKKLGYTTGHIWACPPSE

SEQ ID NO: 2661 - protein, 40 aa, Artificial Sequence
  Description of Artificial Sequence: Synthetic polypeptide
GAFGTVYKGIWIPDGENVKIPVAIKVMRENTSPKANKEIL

SEQ ID NO: 2662 - protein, 40 aa, Artificial Sequence
  Description of Artificial Sequence: Synthetic polypeptide
GAFGTVYKGIWIPDGENVKIPVAIKVSRENTSPKANKEIL

SEQ ID NO: 2663 - protein, 40 aa, Artificial Sequence
  Description of Artificial Sequence: Synthetic polypeptide
AIKILNETTGPKANVEFMDEALIMASMDHPHLVRLLRVCL

SEQ ID NO: 2664 - protein, 40 aa, Artificial Sequence
  Description of Artificial Sequence: Synthetic polypeptide
VLMGHVAAVRLVQYDGRRVVSGAYDFMVKVWDPETETCLH

SEQ ID NO: 2665 - protein, 40 aa, Artificial Sequence
  Description of Artificial Sequence: Synthetic polypeptide
RRVVSGAYDFMVKVWDPETETCLHTLQGHTNRVCSLQFDG

SEQ ID NO: 2666 - protein, 40 aa, Artificial Sequence
  Description of Artificial Sequence: Synthetic polypeptide
FMVKVWDPETETCLHTLQGHTNRVCSLQFDGIHVVSGSLD

SEQ ID NO: 2667 - protein, 40 aa, Artificial Sequence
  Description of Artificial Sequence: Synthetic polypeptide
YDFMVKVWDPETETCLHTLQGHTNRVHSLQFDGIHVVSGS

SEQ ID NO: 2668 - protein, 40 aa, Artificial Sequence
  Description of Artificial Sequence: Synthetic polypeptide
VSGSLDTSIRVWDVETGNCIHTLTGHQVLTSGMELKDNIL

SEQ ID NO: 2669 - protein, 40 aa, Artificial Sequence
  Description of Artificial Sequence: Synthetic polypeptide
TEKDLSDLVSEMEMMKMIGKQKNIINLLGACTQDGPLYVI

SEQ ID NO: 2670 - protein, 40 aa, Artificial Sequence
  Description of Artificial Sequence: Synthetic polypeptide
DLSDLVSEMEMMKMIGKQKNIINLLGACTQDGPLYVIVEY

SEQ ID NO: 2671 - protein, 40 aa, Artificial Sequence
  Description of Artificial Sequence: Synthetic polypeptide
KQKNIINLLGACTQDGPLYVIVEYASKGNLREYLRARRPP

SEQ ID NO: 2672 - protein, 40 aa, Artificial Sequence
  Description of Artificial Sequence: Synthetic polypeptide
EYFYVDFREYEYDLKWEFPRENLEFGKVLESGAFGKVMNA

SEQ ID NO: 2673 - protein, 40 aa, Artificial Sequence
  Description of Artificial Sequence: Synthetic polypeptide
LESGAFGKVMNATAYGISKTGVSIQVAVKMLKEKADSSER

SEQ ID NO: 2674 - protein, 40 aa, Artificial Sequence
  Description of Artificial Sequence: Synthetic polypeptide
NEYFYVDFREYEYDLKWEFPRENLEFGKVLGLGAFGKVMN

SEQ ID NO: 2675 - protein, 40 aa, Artificial Sequence
  Description of Artificial Sequence: Synthetic polypeptide
EYFYVDFREYEYDLKWEFPRENLEFGKVLGLGAFGKVMNA

SEQ ID NO: 2676 - protein, 40 aa, Artificial Sequence
  Description of Artificial Sequence: Synthetic polypeptide
FPRENLEFGKVLGLGAFGKVMNATAYGISKTGVSIQVAVK

SEQ ID NO: 2677 - protein, 40 aa, Artificial Sequence
  Description of Artificial Sequence: Synthetic polypeptide
PRENLEFGKVLGLGAFGKVMNATAYGISKTGVSIQVAVKM

SEQ ID NO: 2678 - protein, 40 aa, Artificial Sequence
  Description of Artificial Sequence: Synthetic polypeptide
EFGKVLGLGAFGKVMNATAYGISKTGVSIQVAVKMLKEKA

SEQ ID NO: 2679 - protein, 40 aa, Artificial Sequence
  Description of Artificial Sequence: Synthetic polypeptide
QSVIFRMVDVGGPRSERRKWIHCFENVTSIMFLVALSEYD

SEQ ID NO: 2680 - protein, 40 aa, Artificial Sequence
  Description of Artificial Sequence: Synthetic polypeptide
HCFENVTSIMFLVALSEYDQVLVESDNENGMEESKALFRT

SEQ ID NO: 2681 - protein, 40 aa, Artificial Sequence
  Description of Artificial Sequence: Synthetic polypeptide
QVLVESDNENGMEESKALFRTIITYPWFQNSSVILFLNKK

SEQ ID NO: 2682 - protein, 40 aa, Artificial Sequence
  Description of Artificial Sequence: Synthetic polypeptide
NENGMEESKALFRTIITYPWFQNSSVILFLNKKDLLEEKI

SEQ ID NO: 2683 - protein, 40 aa, Artificial Sequence
  Description of Artificial Sequence: Synthetic polypeptide
IVALCVLKGGYKFFADLLDYIKALNRNSDRSIPMTVDFIR

SEQ ID NO: 2684 - protein, 40 aa, Artificial Sequence; identical to SEQ ID NO: 1017
  Description of Artificial Sequence: Synthetic polypeptide

SEQ ID NO: 2685 - protein, 40 aa, Artificial Sequence
  Description of Artificial Sequence: Synthetic polypeptide
SVERYEPERDEWHLVAPMLTRRIGVGVAVLNRLLYAVGSF

SEQ ID NO: 2686 - protein, 40 aa, Artificial Sequence
  Description of Artificial Sequence: Synthetic polypeptide
AGMMCIIVMILTYKYLQKPMYEVQWKGVEEINGNNYVYID

SEQ ID NO: 2687 - protein, 40 aa, Artificial Sequence
  Description of Artificial Sequence: Synthetic polypeptide
TYKYLQKPMYEVQWKGVEEINGNNYVYIDPTQLPYDHKWE

SEQ ID NO: 2688 - protein, 40 aa, Artificial Sequence
  Description of Artificial Sequence: Synthetic polypeptide
PMYEVQWKGVEEINGNNYVYIDPTQLPYDHKWEFPRNRLS

SEQ ID NO: 2689 - protein, 40 aa, Artificial Sequence
  Description of Artificial Sequence: Synthetic polypeptide
EVQWKGVEEINGNNYVYIDPTQLPYDHKWEFPRNRLSFGK

SEQ ID NO: 2690 - protein, 40 aa, Artificial Sequence
  Description of Artificial Sequence: Synthetic polypeptide
WKVVEEINGNNYVYIDQTQLPYDHKWEFPRNRLSFGKTLG

SEQ ID NO: 2691 - protein, 40 aa, Artificial Sequence
  Description of Artificial Sequence: Synthetic polypeptide
KVVEEINGNNYVYIDQTQLPYDHKWEFPRNRLSFGKTLGA

SEQ ID NO: 2692 - protein, 40 aa, Artificial Sequence
  Description of Artificial Sequence: Synthetic polypeptide
EEINGNNYVYIDQTQLPYDHKWEFPRNRLSFGKTLGAGAF

SEQ ID NO: 2693 - protein, 40 aa, Artificial Sequence
  Description of Artificial Sequence: Synthetic polypeptide
NGNNYVYIDQTQLPYDHKWEFPRNRLSFGKTLGAGAFGKV

SEQ ID NO: 2694 - protein, 40 aa, Artificial Sequence
  Description of Artificial Sequence: Synthetic polypeptide
PMYEVQWKVVEEINGNNYVYIDPTQPPYDHKWEFPRNRLS

SEQ ID NO: 2695 - protein, 40 aa, Artificial Sequence
  Description of Artificial Sequence: Synthetic polypeptide
KVVEEINGNNYVYIDPTQPPYDHKWEFPRNRLSFGKTLGA

SEQ ID NO: 2696 - protein, 40 aa, Artificial Sequence
  Description of Artificial Sequence: Synthetic polypeptide
EEINGNNYVYIDPTQPPYDHKWEFPRNRLSFGKTLGAGAF

SEQ ID NO: 2697 - protein, 40 aa, Artificial Sequence
  Description of Artificial Sequence: Synthetic polypeptide
INGNNYVYIDPTQPPYDHKWEFPRNRLSFGKTLGAGAFGK

SEQ ID NO: 2698 - protein, 40 aa, Artificial Sequence
  Description of Artificial Sequence: Synthetic polypeptide
SAHLTEREVLMSELKVLSYLGNHMNIVNLLGACTIGGPTL

SEQ ID NO: 2699 - protein, 40 aa, Artificial Sequence
  Description of Artificial Sequence: Synthetic polypeptide
VLMSELKVLSYLGNHMNIVNLLGACTIGGPTLVITEYCCY

SEQ ID NO: 2700 - protein, 40 aa, Artificial Sequence
  Description of Artificial Sequence: Synthetic polypeptide
REAHMSELKVLSYLGNHMNIVNLLGACTIGGPTLVITEYC

SEQ ID NO: 2701 - protein, 40 aa, Artificial Sequence
  Description of Artificial Sequence: Synthetic polypeptide
EVLSYLGNHMNIVNLLGACTIGGPTLVITEYCCYGDLLNF

SEQ ID NO: 2702 - protein, 40 aa, Artificial Sequence
  Description of Artificial Sequence: Synthetic polypeptide
ASKNCIHRDLAARNILLTHGRITKICDFGLARVIKNDSNY

SEQ ID NO: 2703 - protein, 40 aa, Artificial Sequence
  Description of Artificial Sequence: Synthetic polypeptide
TKICDFGLARYIKNDSNYVVKGNARLPVKWMAPESIFNCV

SEQ ID NO: 2704 - protein, 40 aa, Artificial Sequence
  Description of Artificial Sequence: Synthetic polypeptide
VKDSEDVPMVLVGNNCDLPSRTVDTKQAQDLARSYGIPFI

SEQ ID NO: 2705 - protein, 40 aa, Artificial Sequence
  Description of Artificial Sequence: Synthetic polypeptide
VLVGNNCDLPSRTVDTKQAQDLARSYGIPFIETSAKTRQR

SEQ ID NO: 2706 - protein, 40 aa, Artificial Sequence
  Description of Artificial Sequence: Synthetic polypeptide
SAFTIQLIQNHFVDEYDPTIEDSYRKQVVIDGETCLLDIL

SEQ ID NO: 2707 - protein, 40 aa, Artificial Sequence
  Description of Artificial Sequence: Synthetic polypeptide
VGKSALRIQLIQNHFVDEYDPTIEDSYRKQVVIDGETCLL

SEQ ID NO: 2708 - protein, 40 aa, Artificial Sequence
  Description of Artificial Sequence: Synthetic polypeptide
QVVIDGETCLLDILDTGGQEEYSAMRDQYMRTGEGFLCVF

SEQ ID NO: 2709 - protein, 40 aa, Artificial Sequence
  Description of Artificial Sequence: Synthetic polypeptide
GETCLLDILDTGGQEEYSAMRDQYMRTGEGFLCVFAINNT

SEQ ID NO: 2710 - protein, 40 aa, Artificial Sequence
  Description of Artificial Sequence: Synthetic polypeptide
ILDTGGQEEYSAMRDQYMRTGEGFLCVFAINNTKSFEDIH

SEQ ID NO: 2711 - protein, 40 aa, Artificial Sequence
  Description of Artificial Sequence: Synthetic polypeptide
DGETCLLDILDTTGQEEYSAMRDQYMRTGEGFLCVFAINN

SEQ ID NO: 2712 - protein, 40 aa, Artificial Sequence; identical to SEQ ID NO: 887
  Description of Artificial Sequence: Synthetic polypeptide

SEQ ID NO: 2713 - protein, 40 aa, Artificial Sequence
  Description of Artificial Sequence: Synthetic polypeptide
IEDSYRKQVVIDGETCLLDILDTAGKEEYSAMRDQYMRTG

SEQ ID NO: 2714 - protein, 40 aa, Artificial Sequence
  Description of Artificial Sequence: Synthetic polypeptide
SYRKQVVIDGETCLLDILDTAGKEEYSAMRDQYMRTGEGF

SEQ ID NO: 2715 - protein, 40 aa, Artificial Sequence
  Description of Artificial Sequence: Synthetic polypeptide
VDEYDPTIEDSYRKQVVIDGETCLLDILDTAGREEYSAMR

SEQ ID NO: 2716 - protein, 40 aa, Artificial Sequence
  Description of Artificial Sequence: Synthetic polypeptide
QVVIDGETCLLDILDTAGREEYSAMRDQYMRTGEGFLCVF

SEQ ID NO: 2717 - protein, 40 aa, Artificial Sequence
  Description of Artificial Sequence: Synthetic polypeptide
DGETCLLDILDTAGREEYSAMRDQYMRTGEGFLCVFAINN

SEQ ID NO: 2718 - protein, 40 aa, Artificial Sequence
  Description of Artificial Sequence: Synthetic polypeptide
ILDTAGREEYSAMRDQYMRTGEGFLCVFAINNTKSFEDIH

SEQ ID NO: 2719 - protein, 40 aa, Artificial Sequence
  Description of Artificial Sequence: Synthetic polypeptide
QVVIDGETCLLDILDTAGQKEYSAMRDQYMRTGEGFLCVF

SEQ ID NO: 2720 - protein, 40 aa, Artificial Sequence
  Description of Artificial Sequence: Synthetic polypeptide
DGETCLLDILDTAGQKEYSAMRDQYMRTGEGFLCVFAINN

SEQ ID NO: 2721 - protein, 40 aa, Artificial Sequence
  Description of Artificial Sequence: Synthetic polypeptide
ILDTAGQEKYSAMRDQYMRTGEGFLCVFAINNTKSFEDIH

SEQ ID NO: 2722 - protein, 40 aa, Artificial Sequence
  Description of Artificial Sequence: Synthetic polypeptide
VMARKLIHLEIKPAIRNQIIRELQVLHECNSSYIVGFYGA

SEQ ID NO: 2723 - protein, 40 aa, Artificial Sequence
  Description of Artificial Sequence: Synthetic polypeptide
DEKFTVKVADFGLARDMYDKEYYSVHNKTGAKLHVKWMAL

SEQ ID NO: 2724 - protein, 40 aa, Artificial Sequence
  Description of Artificial Sequence: Synthetic polypeptide
DFGLARDMYDKEYYSVHNKTGAKLHVKWMALESLQTQKFT

SEQ ID NO: 2725 - protein, 40 aa, Artificial Sequence
  Description of Artificial Sequence: Synthetic polypeptide
DMYDKEYYSVHNKTGAKLHVKWMALESLQTQKFTTKSDVW

SEQ ID NO: 2726 - protein, 40 aa, Artificial Sequence
  Description of Artificial Sequence: Synthetic polypeptide
MLDEKFTVKVADFGLARDMYDKEYYSVHNKTGAKLPVCWM

SEQ ID NO: 2727 - protein, 40 aa, Artificial Sequence
  Description of Artificial Sequence: Synthetic polypeptide
FGLARDMYDKEYYSVHNKTGAKLPVCWMALESLQTQKFTT

SEQ ID NO: 2728 - protein, 40 aa, Artificial Sequence
  Description of Artificial Sequence: Synthetic polypeptide
LARDMYDKEYYSVHNKTGAKLPVHWMALESLQTQKFTTKS

SEQ ID NO: 2729 - protein, 40 aa, Artificial Sequence
  Description of Artificial Sequence: Synthetic polypeptide
DMYDKEYYSVHNKTGAKLPVHWMALESLQTQKFTTKSDVW

SEQ ID NO: 2730 - protein, 40 aa, Artificial Sequence
  Description of Artificial Sequence: Synthetic polypeptide
QKKLEKERQEQLQKEQEKAFFAQLQLDEGTGEFLPIQPAQ

SEQ ID NO: 2731 - protein, 40 aa, Artificial Sequence
  Description of Artificial Sequence: Synthetic polypeptide
KLEKERQEQLQKEQEKAFFAQLQLDEGTGEFLPIQPAQHI

SEQ ID NO: 2732 - protein, 40 aa, Artificial Sequence
  Description of Artificial Sequence: Synthetic polypeptide
KKLEKERQEQLQKEQEKAFFAQLQLDEQTGEFLPIQPAQH

SEQ ID NO: 2733 - protein, 40 aa, Artificial Sequence
  Description of Artificial Sequence: Synthetic polypeptide
KLEKERQEQLQKEQEKAFFAQLQLDEEAGEFLPIQPAQHI

SEQ ID NO: 2734 - protein, 40 aa, Artificial Sequence
  Description of Artificial Sequence: Synthetic polypeptide
QKKLEKERQEQLQKEQEKAFFAQLQLDEEIGEFLPIQPAQ

SEQ ID NO: 2735 - protein, 40 aa, Artificial Sequence
  Description of Artificial Sequence: Synthetic polypeptide
KLEKERQEQLQKEQEKAFFAQLQLDEEIGEFLPIQPAQHI

SEQ ID NO: 2736 - protein, 40 aa, Artificial Sequence
  Description of Artificial Sequence: Synthetic polypeptide
QKKLEKERQEQLQKEQEKAFFAQLQLDEETSEFLPIQPAQ

SEQ ID NO: 2737 - protein, 40 aa, Artificial Sequence
  Description of Artificial Sequence: Synthetic polypeptide
RQEQLQKEQEKAFFAQLQLDEETSEFLPIQPAQHIQSETS

SEQ ID NO: 2738 - protein, 40 aa, Artificial Sequence
  Description of Artificial Sequence: Synthetic polypeptide
QKKLEKERQEQLQKEQEKAFFAQLQLDEETVEFLPIQPAQ

SEQ ID NO: 2739 - protein, 40 aa, Artificial Sequence
  Description of Artificial Sequence: Synthetic polypeptide
QKKLEKERQEQLQKEQEKAFFAQLQLDEETGDFLPIQPAQ

SEQ ID NO: 2740 - protein, 40 aa, Artificial Sequence
  Description of Artificial Sequence: Synthetic polypeptide
KERQEQLQKEQEKAFFAQLQLDEETGDFLPIQPAQHIQSE

SEQ ID NO: 2741 - protein, 40 aa, Artificial Sequence
  Description of Artificial Sequence: Synthetic polypeptide
VGADGVGKSALTIQLIQNHFVDEYDPTIEDSYRKQVVIDG

SEQ ID NO: 2742 - protein, 40 aa, Artificial Sequence
  Description of Artificial Sequence: Synthetic polypeptide
GVGNSALTIQLIQNHFVDEYDPTIEDSYRKQVVIDGETCL

SEQ ID NO: 2743 - protein, 40 aa, Artificial Sequence
  Description of Artificial Sequence: Synthetic polypeptide
EYDPTIEDSYRKQVVIDGETCLLDILDTAGHEEYSAMRDQ

SEQ ID NO: 2744 - protein, 40 aa, Artificial Sequence
  Description of Artificial Sequence: Synthetic polypeptide
PTIEDSYRKQVVIDGETCLLDILDTAGREEYSAMRDQYMR

SEQ ID NO: 2745 - protein, 40 aa, Artificial Sequence
  Description of Artificial Sequence: Synthetic polypeptide
TAGREEYSAMRDQYMRTGEGFLCVFAINNSKSFADINLYR

SEQ ID NO: 2746 - protein, 40 aa, Artificial Sequence
  Description of Artificial Sequence: Synthetic polypeptide
PTIEDSYRKQVVIDGETCLLDILDTAGQKEYSAMRDQYMR

SEQ ID NO: 2747 - protein, 40 aa, Artificial Sequence
  Description of Artificial Sequence: Synthetic polypeptide
TAGQKEYSAMRDQYMRTGEGFLCVFAINNSKSFADINLYR

SEQ ID NO: 2748 - protein, 40 aa, Artificial Sequence
  Description of Artificial Sequence: Synthetic polypeptide
RISTATPYMNGETSTKSLWVINSALRIKILCATYGNVNIR

SEQ ID NO: 2749 - protein, 40 aa, Artificial Sequence
  Description of Artificial Sequence: Synthetic polypeptide
STATPYMNGETSTKSLWVINSALRIKILCATYGNVNIRDI

SEQ ID NO: 2750 - protein, 40 aa, Artificial Sequence
  Description of Artificial Sequence: Synthetic polypeptide
MNGETSTKSLWVINSALRIKILCATYGNVNIRDIDKIYVR

SEQ ID NO: 2751 - protein, 40 aa, Artificial Sequence
  Description of Artificial Sequence: Synthetic polypeptide
NGETSTKSLWVINSALRIKILCATYGNVNIRDIDKIYVRT

SEQ ID NO: 2752 - protein, 40 aa, Artificial Sequence
  Description of Artificial Sequence: Synthetic polypeptide
GETSTKSLWVINSALRIKILCATYGNVNIRDIDKIYVRTG

SEQ ID NO: 2753 - protein, 40 aa, Artificial Sequence
  Description of Artificial Sequence: Synthetic polypeptide
TSTKSLWVINSALRIKILCATYGNVNIRDIDKIYVRTGIY

SEQ ID NO: 2754 - protein, 40 aa, Artificial Sequence
  Description of Artificial Sequence: Synthetic polypeptide
TKSLWVINSALRIKILCATYGNVNIRDIDKIYVRTGIYHG

SEQ ID NO: 2755 - protein, 40 aa, Artificial Sequence
  Description of Artificial Sequence: Synthetic polypeptide
INSALRIKILCATYGNVNIRDIDKIYVRTGIYHGGEPLCD

SEQ ID NO: 2756 - protein, 40 aa, Artificial Sequence
  Description of Artificial Sequence: Synthetic polypeptide
KSLWVINSALRIKILCATYMNVNIRDIDKIYVRTGIYHGG

SEQ ID NO: 2757 - protein, 40 aa, Artificial Sequence
  Description of Artificial Sequence: Synthetic polypeptide
SLWVINSALRIKILCATYMNVNIRDIDKIYVRTGIYHGGE

SEQ ID NO: 2758 - protein, 40 aa, Artificial Sequence
  Description of Artificial Sequence: Synthetic polypeptide
NSALRIKILCATYMNVNIRDIDKIYVRTGIYHGGEPLCDN

SEQ ID NO: 2759 - protein, 40 aa, Artificial Sequence
  Description of Artificial Sequence: Synthetic polypeptide
ALRIKILCATYMNVNIRDIDKIYVRTGIYHGGEPLCDNVN

SEQ ID NO: 2760 - protein, 40 aa, Artificial Sequence
  Description of Artificial Sequence: Synthetic polypeptide
RIKILCATYMNVNIRDIDKIYVRTGIYHGGEPLCDNVNTQ

SEQ ID NO: 2761 - protein, 40 aa, Artificial Sequence
  Description of Artificial Sequence: Synthetic polypeptide
MNVNIRDIDKIYVRTGIYHGGEPLCDNVNTQRVPCSNPRW

SEQ ID NO: 2762 - protein, 40 aa, Artificial Sequence
  Description of Artificial Sequence: Synthetic polypeptide
TPYMNGETSTKSLWVINSALRIKILCATYVIVNIRDIDKI

SEQ ID NO: 2763 - protein, 40 aa, Artificial Sequence
  Description of Artificial Sequence: Synthetic polypeptide
GETSTKSLWVINSALRIKILCATYVIVNIRDIDKIYVRTG

SEQ ID NO: 2764 - protein, 40 aa, Artificial Sequence
  Description of Artificial Sequence: Synthetic polypeptide
TKSLWVINSALRIKILCATYVIVNIRDIDKIYVRTGIYHG

SEQ ID NO: 2765 - protein, 40 aa, Artificial Sequence
  Description of Artificial Sequence: Synthetic polypeptide
KSLWVINSALRIKILCATYVIVNIRDIDKIYVRTGIYHGG

SEQ ID NO: 2766 - protein, 40 aa, Artificial Sequence
  Description of Artificial Sequence: Synthetic polypeptide
ISTATPYMNGETSTKSLWVINSALRIKILCATYVYVNIRD

SEQ ID NO: 2767 - protein, 40 aa, Artificial Sequence
  Description of Artificial Sequence: Synthetic polypeptide
TATPYMNGETSTKSLWVINSALRIKILCATYVYVNIRDID

SEQ ID NO: 2768 - protein, 40 aa, Artificial Sequence
  Description of Artificial Sequence: Synthetic polypeptide
GETSTKSLWVINSALRIKILCATYVYVNIRDIDKIYVRTG

SEQ ID NO: 2769 - protein, 40 aa, Artificial Sequence
  Description of Artificial Sequence: Synthetic polypeptide
TKSLWVINSALRIKILCATYVYVNIRDIDKIYVRTGIYHG

SEQ ID NO: 2770 - protein, 40 aa, Artificial Sequence
  Description of Artificial Sequence: Synthetic polypeptide
INSALRIKILCATYVYVNIRDIDKIYVRTGIYHGGEPLCD

SEQ ID NO: 2771 - protein, 40 aa, Artificial Sequence
  Description of Artificial Sequence: Synthetic polypeptide
TDTLVSGKMALNLWPVPHGLEDLLNPIGVTGSNPNKETLC

SEQ ID NO: 2772 - protein, 40 aa, Artificial Sequence
  Description of Artificial Sequence: Synthetic polypeptide
MALNLWPVPHGLEDLLNPIGVTGSNPNKETLCLELEFDWF

SEQ ID NO: 2773 - protein, 40 aa, Artificial Sequence
  Description of Artificial Sequence: Synthetic polypeptide
LNLWPVPHGLEDLLNPIGVTGSNPNKETLCLELEFDWFSS

SEQ ID NO: 2774 - protein, 40 aa, Artificial Sequence
  Description of Artificial Sequence: Synthetic polypeptide
NLWPVPHGLEDLLNPIGVTGSNPNKETLCLELEFDWFSSV

SEQ ID NO: 2775 - protein, 40 aa, Artificial Sequence
  Description of Artificial Sequence: Synthetic polypeptide
LWPVPHGLEDLLNPIGVTGSNPNKETLCLELEFDWFSSVV

SEQ ID NO: 2776 - protein, 40 aa, Artificial Sequence
  Description of Artificial Sequence: Synthetic polypeptide
VPHGLEDLLNPIGVTGSNPNKETLCLELEFDWFSSVVKFP

SEQ ID NO: 2777 - protein, 40 aa, Artificial Sequence
  Description of Artificial Sequence: Synthetic polypeptide
PHGLEDLLNPIGVTGSNPNKETLCLELEFDWFSSVVKFPD

SEQ ID NO: 2778 - protein, 40 aa, Artificial Sequence
  Description of Artificial Sequence: Synthetic polypeptide
HGLEDLLNPIGVTGSNPNKETLCLELEFDWFSSVVKFPDM

SEQ ID NO: 2779 - protein, 40 aa, Artificial Sequence
  Description of Artificial Sequence: Synthetic polypeptide
GLEDLLNPIGVTGSNPNKETLCLELEFDWFSSVVKFPDMS

SEQ ID NO: 2780 - protein, 40 aa, Artificial Sequence
  Description of Artificial Sequence: Synthetic polypeptide
LEDLLNPIGVTGSNPNKETLCLELEFDWFSSVVKFPDMSV

SEQ ID NO: 2781 - protein, 40 aa, Artificial Sequence
  Description of Artificial Sequence: Synthetic polypeptide
GVTGSNPNKETLCLELEFDWFSSVVKFPDMSVIEEHANWS

SEQ ID NO: 2782 - protein, 40 aa, Artificial Sequence
  Description of Artificial Sequence: Synthetic polypeptide
VTGSNPNKETLCLELEFDWFSSVVKFPDMSVIEEHANWSV

SEQ ID NO: 2783 - protein, 40 aa, Artificial Sequence
  Description of Artificial Sequence: Synthetic polypeptide
NKETLCLELEFDWFSSVVKFPDMSVIEEHANWSVSREAGF

SEQ ID NO: 2784 - protein, 40 aa, Artificial Sequence
  Description of Artificial Sequence: Synthetic polypeptide
LSEITKQEKDFLWSHRHYCVTIPEILPKLLLSVKWNSRDE

SEQ ID NO: 2785 - protein, 40 aa, Artificial Sequence
  Description of Artificial Sequence: Synthetic polypeptide
EREKDFLWSHRHYCVTIPEILPKLLLSVKWNSRDEVAQMY

SEQ ID NO: 2786 - protein, 40 aa, Artificial Sequence
  Description of Artificial Sequence: Synthetic polypeptide
ERVPFVFTQDFLIVISKGAQECTKTREFERFQEMCYKAYL

SEQ ID NO: 2787 - protein, 40 aa, Artificial Sequence
  Description of Artificial Sequence: Synthetic polypeptide
PFVFTQDFLIVISKGAQECTKTREFERFQEMCYKAYLAIR

SEQ ID NO: 2788 - protein, 40 aa, Artificial Sequence
  Description of Artificial Sequence: Synthetic polypeptide
VFTQDFLIVISKGAQECTKTREFERFQEMCYKAYLAIRQH

SEQ ID NO: 2789 - protein, 40 aa, Artificial Sequence
  Description of Artificial Sequence: Synthetic polypeptide
DASTKMHGDYTLTLRKWGNNKLIKIFHRDGKYGFSDPLTF

SEQ ID NO: 2790 - protein, 40 aa, Artificial Sequence
  Description of Artificial Sequence: Synthetic polypeptide
STKMHGDYTLTLRKWGNNKLIKIFHRDGKYGFSDPLTFSS

SEQ ID NO: 2791 - protein, 40 aa, Artificial Sequence
  Description of Artificial Sequence: Synthetic polypeptide
KMHGDYTLTLRKWGNNKLIKIFHRDGKYGFSDPLTFSSVV

SEQ ID NO: 2792 - protein, 40 aa, Artificial Sequence
  Description of Artificial Sequence: Synthetic polypeptide
LRKWGNNKLIKIFHRDGKYGFSDPLTFSSVVELINHYRNE

SEQ ID NO: 2793 - protein, 40 aa, Artificial Sequence
  Description of Artificial Sequence: Synthetic polypeptide
KMHGDYTLTLRKGRNNKLIKIFHRDGKYGFSDPLTFSSVV

SEQ ID NO: 2794 - protein, 40 aa, Artificial Sequence
  Description of Artificial Sequence: Synthetic polypeptide
YTLTLRKGRNNKLIKIFHRDGKYGFSDPLTFSSVVELINH

SEQ ID NO: 2795 - protein, 40 aa, Artificial Sequence
  Description of Artificial Sequence: Synthetic polypeptide
TLTLRKGRNNKLIKIFHRDGKYGFSDPLTFSSVVELINHY

SEQ ID NO: 2796 - protein, 40 aa, Artificial Sequence
  Description of Artificial Sequence: Synthetic polypeptide
LTLRKGRNNKLIKIFHRDGKYGFSDPLTFSSVVELINHYR

SEQ ID NO: 2797 - protein, 40 aa, Artificial Sequence
  Description of Artificial Sequence: Synthetic polypeptide
TLRKGRNNKLIKIFHRDGKYGFSDPLTFSSVVELINHYRN

SEQ ID NO: 2798 - protein, 40 aa, Artificial Sequence
  Description of Artificial Sequence: Synthetic polypeptide
RKGRNNKLIKIFHRDGKYGFSDPLTFSSVVELINHYRNES

SEQ ID NO: 2799 - protein, 40 aa, Artificial Sequence
  Description of Artificial Sequence: Synthetic polypeptide
RNNKLIKIFHRDGKYGFSDPLTFSSVVELINHYRNESLAQ

SEQ ID NO: 2800 - protein, 40 aa, Artificial Sequence
  Description of Artificial Sequence: Synthetic polypeptide
DASTKMHGDYTLTLRKGGNNELIKIFHRDGKYGFSDPLTF

SEQ ID NO: 2801 - protein, 40 aa, Artificial Sequence
  Description of Artificial Sequence: Synthetic polypeptide
TLTLRKGGNNELIKIFHRDGKYGFSDPLTFSSVVELINHY

SEQ ID NO: 2802 - protein, 40 aa, Artificial Sequence
  Description of Artificial Sequence: Synthetic polypeptide
TLRKGGNNELIKIFHRDGKYGFSDPLTFSSVVELINHYRN

SEQ ID NO: 2803 - protein, 40 aa, Artificial Sequence
  Description of Artificial Sequence: Synthetic polypeptide
KGGNNELIKIFHRDGKYGFSDPLTFSSVVELINHYRNESL

SEQ ID NO: 2804 - protein, 40 aa, Artificial Sequence
  Description of Artificial Sequence: Synthetic polypeptide
STKMHGDYTLTLRKGGNNNLIKIFHRDGKYGFSDPLTFSS

SEQ ID NO: 2805 - protein, 40 aa, Artificial Sequence
  Description of Artificial Sequence: Synthetic polypeptide
TKMHGDYTLTLRKGGNNNLIKIFHRDGKYGFSDPLTFSSV

SEQ ID NO: 2806 - protein, 40 aa, Artificial Sequence
  Description of Artificial Sequence: Synthetic polypeptide
DYTLTLRKGGNNNLIKIFHRDGKYGFSDPLTFSSVVELIN

SEQ ID NO: 2807 - protein, 40 aa, Artificial Sequence
  Description of Artificial Sequence: Synthetic polypeptide
YTLTLRKGGNNNLIKIFHRDGKYGFSDPLTFSSVVELINH

SEQ ID NO: 2808 - protein, 40 aa, Artificial Sequence
  Description of Artificial Sequence: Synthetic polypeptide
LTLRKGGNNNLIKIFHRDGKYGFSDPLTFSSVVELINHYR

SEQ ID NO: 2809 - protein, 40 aa, Artificial Sequence
  Description of Artificial Sequence: Synthetic polypeptide
TLRKGGNNNLIKIFHRDGKYGFSDPLTFSSVVELINHYRN

SEQ ID NO: 2810 - protein, 40 aa, Artificial Sequence
  Description of Artificial Sequence: Synthetic polypeptide
LRKGGNNNLIKIFHRDGKYGFSDPLTFSSVVELINHYRNE

SEQ ID NO: 2811 - protein, 40 aa, Artificial Sequence
  Description of Artificial Sequence: Synthetic polypeptide
RKGGNNNLIKIFHRDGKYGFSDPLTFSSVVELINHYRNES

SEQ ID NO: 2812 - protein, 40 aa, Artificial Sequence
  Description of Artificial Sequence: Synthetic polypeptide
KGGNNNLIKIFHRDGKYGFSDPLTFSSVVELINHYRNESL

SEQ ID NO: 2813 - protein, 40 aa, Artificial Sequence
  Description of Artificial Sequence: Synthetic polypeptide
GGNNNLIKIFHRDGKYGFSDPLTFSSVVELINHYRNESLA

SEQ ID NO: 2814 - protein, 40 aa, Artificial Sequence
  Description of Artificial Sequence: Synthetic polypeptide
NYDKLKSRISEIIDSRRRLEEDLKKQAAEYPEIDKRMNSI

SEQ ID NO: 2815 - protein, 40 aa, Artificial Sequence
  Description of Artificial Sequence: Synthetic polypeptide
QRIMHNYDKLKSRISEIIDSRRRLEEDLKKQAAEYREIGK

SEQ ID NO: 2816 - protein, 40 aa, Artificial Sequence
  Description of Artificial Sequence: Synthetic polypeptide
NYDKLKSRISEIIDSRRRLEEDLKKQAAEYREIGKRMNSI

SEQ ID NO: 2817 - protein, 40 aa, Artificial Sequence
  Description of Artificial Sequence: Synthetic polypeptide
KSRISEIIDSRRRLEEDLKKQAAEYREIGKRMNSIKPDLI

SEQ ID NO: 2818 - protein, 40 aa, Artificial Sequence
  Description of Artificial Sequence: Synthetic polypeptide
RISEIIDSRRRLEEDLKKQAAEYREIYKRMNSIKPDLIQL

SEQ ID NO: 2819 - protein, 40 aa, Artificial Sequence
  Description of Artificial Sequence: Synthetic polypeptide
RRLEEDLKKQAAEYREIYKRMNSIKPDLIQLRKTRDQYLM

SEQ ID NO: 2820 - protein, 40 aa, Artificial Sequence
  Description of Artificial Sequence: Synthetic polypeptide
SRISEIIDSRRRLEEDLKKQAAEYREIDKRMNRIKPDLIQ

SEQ ID NO: 2821 - protein, 40 aa, Artificial Sequence
  Description of Artificial Sequence: Synthetic polypeptide
EIIDSRRRLEEDLKKQAAEYREIDKRMNRIKPDLIQLRKT

SEQ ID NO: 2822 - protein, 40 aa, Artificial Sequence
  Description of Artificial Sequence: Synthetic polypeptide
REIDKRMNRIKPDLIQLRKTRDQYLMWLTQKGVRQKKLNE

SEQ ID NO: 2823 - protein, 40 aa, Artificial Sequence
  Description of Artificial Sequence: Synthetic polypeptide
KLKSRISEIIDSRRRLEEDLKKQAAEYREIDKRMNSIKTD

SEQ ID NO: 2824 - protein, 40 aa, Artificial Sequence
  Description of Artificial Sequence: Synthetic polypeptide
RISEIIDSRRRLEEDLKKQAAEYREIDKRMNSIKTDLIQL

SEQ ID NO: 2825 - protein, 40 aa, Artificial Sequence
  Description of Artificial Sequence: Synthetic polypeptide
RRRLEEDLKKQAAEYREIDKRMNSIKTDLIQLRKTRDQYL

SEQ ID NO: 2826 - protein, 40 aa, Artificial Sequence
  Description of Artificial Sequence: Synthetic polypeptide
VSSAVKAELRQYFRNLCSDDTPMVWRAAASKLGEFAKVLE

SEQ ID NO: 2827 - protein, 40 aa, Artificial Sequence
  Description of Artificial Sequence: Synthetic polypeptide
QGFWEEFETLQQQECKLLYSRKEGQRQENKNKNRCKNILP

SEQ ID NO: 2828 - protein, 40 aa, Artificial Sequence
  Description of Artificial Sequence: Synthetic polypeptide
LQQQECKLLYSRKEGQRQENKNKNRCKNILPFDHTRVVLH

SEQ ID NO: 2829 - protein, 40 aa, Artificial Sequence
  Description of Artificial Sequence: Synthetic polypeptide
QECKLLYSRKEGQRQENKNKNRCKNILPFDHTRVVLHDGD

SEQ ID NO: 2830 - protein, 40 aa, Artificial Sequence
  Description of Artificial Sequence: Synthetic polypeptide
CKLLYSRKEGQRQENKNKNRCKNILPFDHTRVVLHDGDPN

SEQ ID NO: 2831 - protein, 40 aa, Artificial Sequence
  Description of Artificial Sequence: Synthetic polypeptide
KLLYSRKEGQRQENKNKNRCKNILPFDHTRVVLHDGDPNE

SEQ ID NO: 2832 - protein, 40 aa, Artificial Sequence
  Description of Artificial Sequence: Synthetic polypeptide
LYSRKEGQRQENKNKNRCKNILPFDHTRVVLHDGDPNEPV

SEQ ID NO: 2833 - protein, 40 aa, Artificial Sequence
  Description of Artificial Sequence: Synthetic polypeptide
KNKNRYKNMLPFDHTRVVLHDGDPNEPVSDYINANIIMPE

SEQ ID NO: 2834 - protein, 40 aa, Artificial Sequence
  Description of Artificial Sequence: Synthetic polypeptide
GRTGTFIVIDILIDIIREKGVDCDIDVPKTIQMVRSQRSV

SEQ ID NO: 2835 - protein, 40 aa, Artificial Sequence
  Description of Artificial Sequence: Synthetic polypeptide
TGTFIVIDILIDIIREKGVDCDIDVPKTIQMVRSQRSVMV

SEQ ID NO: 2836 - protein, 40 aa, Artificial Sequence
  Description of Artificial Sequence: Synthetic polypeptide
IVIDILIDIIREKGVDCDIDVPKTIQMVRSQRSVMVQTEA

SEQ ID NO: 2837 - protein, 40 aa, Artificial Sequence
  Description of Artificial Sequence: Synthetic polypeptide
VIDILIDIIREKGVDCDIDVPKTIQMVRSQRSVMVQTEAQ

SEQ ID NO: 2838 - protein, 40 aa, Artificial Sequence
  Description of Artificial Sequence: Synthetic polypeptide
DCDIDVPKTIQMVRSQRSVMVQTEAQYRFIYMAVQHYIET

SEQ ID NO: 2839 - protein, 40 aa, Artificial Sequence
  Description of Artificial Sequence: Synthetic polypeptide
RSVMVQTEAQYRFIYMAVQHYIETLQRRIEEEQKSKRKGH

SEQ ID NO: 2840 - protein, 40 aa, Artificial Sequence
  Description of Artificial Sequence: Synthetic polypeptide
VQTEAHYRFIYMAVQHYIETLQRRIEEEQKSKRKGHEYTN

SEQ ID NO: 2841 - protein, 40 aa, Artificial Sequence
  Description of Artificial Sequence: Synthetic polypeptide
VGKTCLLISYTTNAFLGEYIPTVFDNYSANVMVDGKPVNL

SEQ ID NO: 2842 - protein, 40 aa, Artificial Sequence
  Description of Artificial Sequence: Synthetic polypeptide
DGKPVNLGLWDTAGQEDYDRLHPLSYPQTVGETYGKDITS

SEQ ID NO: 2843 - protein, 40 aa, Artificial Sequence
  Description of Artificial Sequence: Synthetic polypeptide
GKPVNLGLWDTAGQEDYDRLHPLSYPQTVGETYGKDITSR

SEQ ID NO: 2844 - protein, 40 aa, Artificial Sequence
  Description of Artificial Sequence: Synthetic polypeptide
EDYDRLHPLSYPQTVGETYGKDITSRGKDKPIADVFLICF

SEQ ID NO: 2845 - protein, 40 aa, Artificial Sequence
  Description of Artificial Sequence: Synthetic polypeptide
DYDRLHPLSYPQTVGETYGKDITSRGKDKPIADVFLICFS

SEQ ID NO: 2846 - protein, 40 aa, Artificial Sequence
  Description of Artificial Sequence: Synthetic polypeptide
FDFYKVIESFIKAEGNLTREMIKHLERCEHRIMESLASLS

SEQ ID NO: 2847 - protein, 40 aa, Artificial Sequence
  Description of Artificial Sequence: Synthetic polypeptide
DFYKVIESFIKAEGNLTREMIKHLERCEHRIMESLASLSD

SEQ ID NO: 2848 - protein, 40 aa, Artificial Sequence
  Description of Artificial Sequence: Synthetic polypeptide
FYKVIESFIKAEGNLTREMIKHLERCEHRIMESLASLSDS

SEQ ID NO: 2849 - protein, 40 aa, Artificial Sequence
  Description of Artificial Sequence: Synthetic polypeptide
KVIESFIKAEGNLTREMIKHLERCEHRIMESLASLSDSPL

SEQ ID NO: 2850 - protein, 40 aa, Artificial Sequence
  Description of Artificial Sequence: Synthetic polypeptide
VIESFIKAEGNLTREMIKHLERCEHRIMESLASLSDSPLF

SEQ ID NO: 2851 - protein, 40 aa, Artificial Sequence
  Description of Artificial Sequence: Synthetic polypeptide
IESFIKAEGNLTREMIKHLERCEHRIMESLASLSDSPLFD

SEQ ID NO: 2852 - protein, 40 aa, Artificial Sequence
  Description of Artificial Sequence: Synthetic polypeptide
ESFIKAEGNLTREMIKHLERCEHRIMESLASLSDSPLFDL

SEQ ID NO: 2853 - protein, 40 aa, Artificial Sequence
  Description of Artificial Sequence: Synthetic polypeptide
KAEGNLTREMIKHLERCEHRIMESLASLSDSPLFDLIKQS

SEQ ID NO: 2854 - protein, 40 aa, Artificial Sequence
  Description of Artificial Sequence: Synthetic polypeptide
AEGNLTREMIKHLERCEHRIMESLASLSDSPLFDLIKQSK

SEQ ID NO: 2855 - protein, 40 aa, Artificial Sequence
  Description of Artificial Sequence: Synthetic polypeptide
NLTREMIKHLERCEHRIMESLASLSDSPLFDLIKQSKDRE

SEQ ID NO: 2856 - protein, 40 aa, Artificial Sequence
  Description of Artificial Sequence: Synthetic polypeptide
LTREMIKHLERCEHRIMESLASLSDSPLFDLIKQSKDREG

SEQ ID NO: 2857 - protein, 40 aa, Artificial Sequence
  Description of Artificial Sequence: Synthetic polypeptide
IENTFTKLITVNGQEYHLQLVVTAGQDEYSIFPQTYSIDI

SEQ ID NO: 2858 - protein, 40 aa, Artificial Sequence
  Description of Artificial Sequence: Synthetic polypeptide
ENTFTKLITVNGQEYHLQLVVTAGQDEYSIFPQTYSIDIN

SEQ ID NO: 2859 - protein, 40 aa, Artificial Sequence
  Description of Artificial Sequence: Synthetic polypeptide
GAFGYMECSTKTKDGVREVFEMATRAALQARRGKKKSGCL

SEQ ID NO: 2860 - protein, 40 aa, Artificial Sequence
  Description of Artificial Sequence: Synthetic polypeptide
GAFGYMECSVKTKDGVREVFEMATRAALQARRGKKKSGCL

SEQ ID NO: 2861 - protein, 40 aa, Artificial Sequence
  Description of Artificial Sequence: Synthetic polypeptide
ACGKTCLLIVFSKDQFPEVYVPTVFENCVADIEVDGKQVE

SEQ ID NO: 2862 - protein, 40 aa, Artificial Sequence
  Description of Artificial Sequence: Synthetic polypeptide
KTCLLIVFSKDQFPEVYVPTVFENCVADIEVDGKQVELAL

SEQ ID NO: 2863 - protein, 40 aa, Artificial Sequence
  Description of Artificial Sequence: Synthetic polypeptide
VPTVFENCVADIEVDGKQVELALWDTAGQEDYDRLRPLSY

SEQ ID NO: 2864 - protein, 40 aa, Artificial Sequence
  Description of Artificial Sequence: Synthetic polypeptide
NYVADIKVDGKQVELALWDTAGQEDYDRLRPLSYPDTDVI

SEQ ID NO: 2865 - protein, 40 aa, Artificial Sequence
  Description of Artificial Sequence: Synthetic polypeptide
VELALWGTAGQEDYDRLRPLSYPDTDVILMCFSIDSPDSL

SEQ ID NO: 2866 - protein, 40 aa, Artificial Sequence
  Description of Artificial Sequence: Synthetic polypeptide
FENYVADIEVDGKQVELALWYTAGQEDYDRLRPLSYPDTD

SEQ ID NO: 2867 - protein, 40 aa, Artificial Sequence
  Description of Artificial Sequence: Synthetic polypeptide
DIEVDGKQVELALWYTAGQEDYDRLRPLSYPDTDVILMCF

SEQ ID NO: 2868 - protein, 40 aa, Artificial Sequence
  Description of Artificial Sequence: Synthetic polypeptide
KDQFPEVYVPTVFENYVADIEVDGKQVELALWDKAGQEDY

SEQ ID NO: 2869 - protein, 40 aa, Artificial Sequence
  Description of Artificial Sequence: Synthetic polypeptide
NYVADIEVDGKQVELALWDKAGQEDYDRLRPLSYPDTDVI

SEQ ID NO: 2870 - protein, 40 aa, Artificial Sequence
  Description of Artificial Sequence: Synthetic polypeptide
VFSKDQFPEVYVPTVFENYVADIEVDGKQVELALWDTAGK

SEQ ID NO: 2871 - protein, 40 aa, Artificial Sequence
  Description of Artificial Sequence: Synthetic polypeptide
FPEVYVPTVFENYVADIEVDGKQVELALWDTAGKEDYDRL

SEQ ID NO: 2872 - protein, 40 aa, Artificial Sequence
  Description of Artificial Sequence: Synthetic polypeptide
LALWDTAGQEDYDRLSPLSYPDTDVILMCFSIDSPDSLEN

SEQ ID NO: 2873 - protein, 40 aa, Artificial Sequence
  Description of Artificial Sequence: Synthetic polypeptide
HPGELVRTDSPNFLCSVLPTHWRCNNTLPIAFKVVALGDV

SEQ ID NO: 2874 - protein, 40 aa, Artificial Sequence
  Description of Artificial Sequence: Synthetic polypeptide
LLMIECSSRCPNGDYCSNRQFQRKQHADVEVILTEKKGWG

SEQ ID NO: 2875 - protein, 40 aa, Artificial Sequence
  Description of Artificial Sequence: Synthetic polypeptide
KEFKARVKEYARNKNIHYYFMALKNDEIIDATQKGNCSCF

SEQ ID NO: 2876 - protein, 40 aa, Artificial Sequence
  Description of Artificial Sequence: Synthetic polypeptide
IHYYFMALKNDEIIDATQKGNCSCFMNHSCEPNCETQKWT

SEQ ID NO: 2877 - protein, 40 aa, Artificial Sequence
  Description of Artificial Sequence: Synthetic polypeptide
DEIIDATQKGNCSCFMNHSCEPNCETQKWTVNGQLRVGFF

SEQ ID NO: 2878 - protein, 40 aa, Artificial Sequence
  Description of Artificial Sequence: Synthetic polypeptide
FKARVKEYARNKNIHYYFMALKNDEIIDATQKGNCSLFMN

SEQ ID NO: 2879 - protein, 40 aa, Artificial Sequence
  Description of Artificial Sequence: Synthetic polypeptide
CKSKKSWQARHTGIEIVQQIAILMGCAILPHLRSLVEIIE

SEQ ID NO: 2880 - protein, 40 aa, Artificial Sequence
  Description of Artificial Sequence: Synthetic polypeptide
QARHTGIEIVQQIAILMGCAILPHLRSLVEIIEHGLVDEQ

SEQ ID NO: 2881 - protein, 40 aa, Artificial Sequence
  Description of Artificial Sequence: Synthetic polypeptide
AIAALAEAATPYGIESFDSVLKPLWKGIRQHRGEGLAAFL

SEQ ID NO: 2882 - protein, 40 aa, Artificial Sequence
  Description of Artificial Sequence: Synthetic polypeptide
AEAATPYGIESFDSVLKPLWKGIRQHRGKGLAAVLKAIGY

SEQ ID NO: 2883 - protein, 40 aa, Artificial Sequence
  Description of Artificial Sequence: Synthetic polypeptide
EAATPYGIESFDSVLKPLWKGIRQHRGKGLAAVLKAIGYL

SEQ ID NO: 2884 - protein, 40 aa, Artificial Sequence
  Description of Artificial Sequence: Synthetic polypeptide
YRKMVMETIEKIMGNLGAADIDHKLEEQLIDGILYAFQGQ

SEQ ID NO: 2885 - protein, 40 aa, Artificial Sequence
  Description of Artificial Sequence: Synthetic polypeptide
RKMVMETIEKIMGNLGAADIDHKLEEQLIDGILYAFQGQT

SEQ ID NO: 2886 - protein, 40 aa, Artificial Sequence
  Description of Artificial Sequence: Synthetic polypeptide
ETIEKIMGNLGAADIDHKLEEQLIDGILYAFQGQTTEDSV

SEQ ID NO: 2887 - protein, 40 aa, Artificial Sequence
  Description of Artificial Sequence: Synthetic polypeptide
IEKIMGNLGAADIDHKLEEQLIDGILYAFQGQTTEDSVML

SEQ ID NO: 2888 - protein, 40 aa, Artificial Sequence
  Description of Artificial Sequence: Synthetic polypeptide
YRKMVMETIEKIMGNLGAADIDHKLEEQLIDGILYAFQKQ

SEQ ID NO: 2889 - protein, 40 aa, Artificial Sequence
  Description of Artificial Sequence: Synthetic polypeptide
TIEKIMGNLGAADIDHKLEEQLIDGILYAFQKQTTEDSVM

SEQ ID NO: 2890 - protein, 40 aa, Artificial Sequence
  Description of Artificial Sequence: Synthetic polypeptide
RKMVMETIEKIMGNLGAADIDHKLEEQLIDGILYAFQEPT

SEQ ID NO: 2891 - protein, 40 aa, Artificial Sequence
  Description of Artificial Sequence: Synthetic polypeptide
TIEKIMGNLGAADIDHKLEEQLIDGILYAFQEPTTEDSVM

SEQ ID NO: 2892 - protein, 40 aa, Artificial Sequence
  Description of Artificial Sequence: Synthetic polypeptide
YRRQTVTSTPCWIELHLNGPLQWLNKVLTQMGSPSVRCSS

SEQ ID NO: 2893 - protein, 40 aa, Artificial Sequence
  Description of Artificial Sequence: Synthetic polypeptide
WCSIAYFEMDVQVGETLKVPSSCPIVTVDGYVDPSGGDRF

SEQ ID NO: 2894 - protein, 40 aa, Artificial Sequence
  Description of Artificial Sequence: Synthetic polypeptide
IAYFEMDVQVGETLKVPSSCPIVTVDGYVDPSGGDRFCLG

SEQ ID NO: 2895 - protein, 40 aa, Artificial Sequence
  Description of Artificial Sequence: Synthetic polypeptide
SNHPAPEYWCSIAYFEMDVQVGETFKVPSSCPIVTVGGYV

SEQ ID NO: 2896 - protein, 40 aa, Artificial Sequence
  Description of Artificial Sequence: Synthetic polypeptide
HPAPEYWCSIAYFEMDVQVGETFKVPSSCPIVTVHGYVDP

SEQ ID NO: 2897 - protein, 40 aa, Artificial Sequence
  Description of Artificial Sequence: Synthetic polypeptide
PAPEYWCSIAYFEMDVQVGETFKVPSSCPIVTVHGYVDPS

SEQ ID NO: 2898 - protein, 40 aa, Artificial Sequence
  Description of Artificial Sequence: Synthetic polypeptide
IAYFEMDVQVGETFKVPSSCPIVTVDRYVDPSGGDRFCLG

SEQ ID NO: 2899 - protein, 40 aa, Artificial Sequence
  Description of Artificial Sequence: Synthetic polypeptide
PEYWCSIAYFEMDVQVGETFKVPSSCPIVTVDVYVDPSGG

SEQ ID NO: 2900 - protein, 40 aa, Artificial Sequence
  Description of Artificial Sequence: Synthetic polypeptide
IAYFEMDVQVGETFKVPSSCPIVTVDVYVDPSGGDRFCLG

SEQ ID NO: 2901 - protein, 40 aa, Artificial Sequence
  Description of Artificial Sequence: Synthetic polypeptide
PAPEYWCSIAYFEMDVQVGETFKVPSSCPIVTVDGCVDPS

SEQ ID NO: 2902 - protein, 40 aa, Artificial Sequence
  Description of Artificial Sequence: Synthetic polypeptide
PEYWCSIAYFEMDVQVGETFKVPSSCPIVTVDGCVDPSGG

SEQ ID NO: 2903 - protein, 40 aa, Artificial Sequence
  Description of Artificial Sequence: Synthetic polypeptide
AYFEMDVQVGETFKVPSSCPIVTVDGCVDPSGGDRFCLGQ

SEQ ID NO: 2904 - protein, 40 aa, Artificial Sequence
  Description of Artificial Sequence: Synthetic polypeptide
YWCSIAYFEMDVQVGETFKVPSSCPIVTVDGYVYPSGGDR

SEQ ID NO: 2905 - protein, 40 aa, Artificial Sequence
  Description of Artificial Sequence: Synthetic polypeptide
SIAYFEMDVQVGETFKVPSSCPIVTVDGYVYPSGGDRFCL

SEQ ID NO: 2906 - protein, 40 aa, Artificial Sequence
  Description of Artificial Sequence: Synthetic polypeptide
AYFEMDVQVGETFKVPSSCPIVTVDGYVDLSGGDRFCLGQ

SEQ ID NO: 2907 - protein, 40 aa, Artificial Sequence
  Description of Artificial Sequence: Synthetic polypeptide
WCSIAYFEMDVQVGETFKVPSSCPIVTVDGYVDPSGGDCF

SEQ ID NO: 2908 - protein, 40 aa, Artificial Sequence
  Description of Artificial Sequence: Synthetic polypeptide
IAYFEMDVQVGETFKVPSSCPIVTVDGYVDPSGGDRFCLR

SEQ ID NO: 2909 - protein, 40 aa, Artificial Sequence
  Description of Artificial Sequence: Synthetic polypeptide
FEMDVQVGETFKVPSSCPIVTVDGYVDPSGGDRFCLGQLC

SEQ ID NO: 2910 - protein, 40 aa, Artificial Sequence
  Description of Artificial Sequence: Synthetic polypeptide
HIGKGVQLECKGEGDVWVRCLSDHVVFVQSYYLDREAGRA

SEQ ID NO: 2911 - protein, 40 aa, Artificial Sequence
  Description of Artificial Sequence: Synthetic polypeptide
VVFVQSYYLDREAGRAPGDAVHKIYPSAYIKVFDLRQCHR

SEQ ID NO: 2912 - protein, 40 aa, Artificial Sequence
  Description of Artificial Sequence: Synthetic polypeptide
TKAMESQRAYRFVQGKDGGFKKFIRRDFLLDEANGLLPDD

SEQ ID NO: 2913 - protein, 40 aa, Artificial Sequence
  Description of Artificial Sequence: Synthetic polypeptide
NLLLVSCPKSEVRAKFKFSILNAKGEETKAMESQRAYRFV

SEQ ID NO: 2914 - protein, 40 aa, Artificial Sequence
  Description of Artificial Sequence: Synthetic polypeptide
PAPSWPLSSSVPSQKTYQCSYGFRLGFLHSGTAKSVTCTY

SEQ ID NO: 2915 - protein, 40 aa, Artificial Sequence
  Description of Artificial Sequence: Synthetic polypeptide
TPAAPAPAPSWPLSSSVPSQKTYQVSYGFRLGFLHSGTAK

SEQ ID NO: 2916 - protein, 40 aa, Artificial Sequence
  Description of Artificial Sequence: Synthetic polypeptide
SWPLSSSVPSQKTYQVSYGFRLGFLHSGTAKSVTCTYSPA

SEQ ID NO: 2917 - protein, 40 aa, Artificial Sequence
  Description of Artificial Sequence: Synthetic polypeptide
PTPAAPAPAPSWPLSSSVPSQKTYQGSYGFPLGFLHSGTA

SEQ ID NO: 2918 - protein, 40 aa, Artificial Sequence
  Description of Artificial Sequence: Synthetic polypeptide
AAPAPAPSWPLSSSVPSQKTYQGSYGFRRGFLHSGTAKSV

SEQ ID NO: 2919 - protein, 40 aa, Artificial Sequence
  Description of Artificial Sequence: Synthetic polypeptide
PAPAPSWPLSSSVPSQKTYQGSYGFRRGFLHSGTAKSVTC

SEQ ID NO: 2920 - protein, 40 aa, Artificial Sequence
  Description of Artificial Sequence: Synthetic polypeptide
APTPAAPAPAPSWPLSSSVPSQKTYQGSYGFRLGVLHSGT

SEQ ID NO: 2921 - protein, 40 aa, Artificial Sequence
  Description of Artificial Sequence: Synthetic polypeptide
AAPAPAPSWPLSSSVPSQKTYQGSYGFRLGFLHSGTAKYV

SEQ ID NO: 2922 - protein, 40 aa, Artificial Sequence
  Description of Artificial Sequence: Synthetic polypeptide
PSQKTYQGSYGFRLGFLHSGTAKSVTCTYSPARNKMFCQL

SEQ ID NO: 2923 - protein, 40 aa, Artificial Sequence
  Description of Artificial Sequence: Synthetic polypeptide
SVPSQKTYQGSYGFRLGFLHSGTAKSVTCTYSPAVNKMFC

SEQ ID NO: 2924 - protein, 40 aa, Artificial Sequence
  Description of Artificial Sequence: Synthetic polypeptide
TYSPALNKMFCQQAKTCPVQLWVDSTPPPGTRVRAMAIYK

SEQ ID NO: 2925 - protein, 40 aa, Artificial Sequence
  Description of Artificial Sequence: Synthetic polypeptide
YGFRLGFLHSGTAKSVTCTYSPALNKMFCQLAKTCLVQLW

SEQ ID NO: 2926 - protein, 40 aa, Artificial Sequence
  Description of Artificial Sequence: Synthetic polypeptide
RAMAIYEQSQHMTEVVRRCPHHERCSDSDGLAPPQHLIRV

SEQ ID NO: 2927 - protein, 40 aa, Artificial Sequence
  Description of Artificial Sequence: Synthetic polypeptide
VQLWVDSTPPPGTRVRAMAIYKQSQHMTEVGRRCPHHERC

SEQ ID NO: 2928 - protein, 40 aa, Artificial Sequence
  Description of Artificial Sequence: Synthetic polypeptide
YKQSQHMTEVVRRFPHHERCSDSDGLAPPQHLIRVEGNLR

SEQ ID NO: 2929 - protein, 40 aa, Artificial Sequence
  Description of Artificial Sequence: Synthetic polypeptide
QHMTEVVRRFPHHERCSDSDGLAPPQHLIRVEGNLRVEYL

SEQ ID NO: 2930 - protein, 40 aa, Artificial Sequence
  Description of Artificial Sequence: Synthetic polypeptide
PVQLWVDSTPPPGTRVRAMAIYKQSQHMTEVVRRCPHRER

SEQ ID NO: 2931 - protein, 40 aa, Artificial Sequence
  Description of Artificial Sequence: Synthetic polypeptide
YKQSQHMTEVVRRCPHHERCSDSDGLALPQHLIRVEGNLR

SEQ ID NO: 2932 - protein, 40 aa, Artificial Sequence
  Description of Artificial Sequence: Synthetic polypeptide
SDSDGLAPPQHHIRVEGNLRVEYLDDRNTFRHSVVVPYEP

SEQ ID NO: 2933 - protein, 40 aa, Artificial Sequence
  Description of Artificial Sequence: Synthetic polypeptide
QHMTEVVRRCPHHERCSDSDGLAPPQHLFRVEGNLRVEYL

SEQ ID NO: 2934 - protein, 40 aa, Artificial Sequence
  Description of Artificial Sequence: Synthetic polypeptide
SDGLAPPQHLIRGEGNLRVEYLDDRNTFRHSVVVPYEPPE

SEQ ID NO: 2935 - protein, 40 aa, Artificial Sequence
  Description of Artificial Sequence: Synthetic polypeptide
QHLIRVEGNLRVESLDDRNTFRHSVVVPYEPPEVGSDCTT

SEQ ID NO: 2936 - protein, 40 aa, Artificial Sequence
  Description of Artificial Sequence: Synthetic polypeptide
CSDSDGLAPPQHLIRVEGNLRVEYLDDRNIFRHSVVVPYE

SEQ ID NO: 2937 - protein, 40 aa, Artificial Sequence
  Description of Artificial Sequence: Synthetic polypeptide
APPQHLIRVEGNLRVEYLDDRNIFRHSVVVPYEPPEVGSD

SEQ ID NO: 2938 - protein, 40 aa, Artificial Sequence
  Description of Artificial Sequence: Synthetic polypeptide
SDGLAPPQHLIRVEGNLRVEYLDDRNTFLHSVVVPYEPPE

SEQ ID NO: 2939 - protein, 40 aa, Artificial Sequence
  Description of Artificial Sequence: Synthetic polypeptide
SSCMSGMNRRPILTIITLEDSSGNLLGRNSFEVRVCACPG

SEQ ID NO: 2940 - protein, 40 aa, Artificial Sequence
  Description of Artificial Sequence: Synthetic polypeptide
CMGGMNRRPILTIITLEDSSGNLLGRNSFEVRVCACPGRH

SEQ ID NO: 2941 - protein, 40 aa, Artificial Sequence
  Description of Artificial Sequence: Synthetic polypeptide
GMNRRPILTIITLEDSSGNLLGRNSFEVRVCACPGRDRRP

SEQ ID NO: 2942 - protein, 40 aa, Artificial Sequence
  Description of Artificial Sequence: Synthetic polypeptide
SFEVRVCACPGRDRRTKEENLRKKGEPHHELPPGSTKRAL

SEQ ID NO: 2943 - protein, 40 aa, Artificial Sequence
  Description of Artificial Sequence: Synthetic polypeptide
KPLDGEYFTLQIRGRERFEMFRELNEASELKDAQAGKEPG

SEQ ID NO: 2944 - protein, 40 aa, Artificial Sequence
  Description of Artificial Sequence: Synthetic polypeptide
TLPPGTGRRIHSYRGNLWLFRDAGTHDGLLVNQTELFVPS

SEQ ID NO: 2945 - protein, 40 aa, Artificial Sequence
  Description of Artificial Sequence: Synthetic polypeptide
GTHDGLLVNQTELFVPSLNVDGQPIFANITLPVYTLKEQC

SEQ ID NO: 2946 - protein, 40 aa, Artificial Sequence
  Description of Artificial Sequence: Synthetic polypeptide
GLLVNQTELFVPSLNVDGQPIFANITLPVYTLKERCLQDV

SEQ ID NO: 2947 - protein, 40 aa, Artificial Sequence
  Description of Artificial Sequence: Synthetic polypeptide
YTLKERCLQVVRSLVKPENYRRPDIVRSLYEDLEDHPNVQ

SEQ ID NO: 2948 - protein, 40 aa, Artificial Sequence
  Description of Artificial Sequence: Synthetic polypeptide
TLPVYTLKERCLQVVRSLVKPENYRRLDIVRSPYEDLEDH

SEQ ID NO: 2949 - protein, 40 aa, Artificial Sequence
  Description of Artificial Sequence: Synthetic polypeptide
WEIPDGQITVGQRIVSGSFGTVYKGKWHGDVAVKMLNVTA

SEQ ID NO: 2950 - protein, 40 aa, Artificial Sequence
  Description of Artificial Sequence: Synthetic polypeptide
FEMIKLIDIARQTAQGMDYLHAKSIIHKDLKSNNIFLHED

SEQ ID NO: 2951 - protein, 40 aa, Artificial Sequence
  Description of Artificial Sequence: Synthetic polypeptide
MIKLIDIARQTAQGMDYLHAKSIIHKDLKSNNIFLHEDLT

SEQ ID NO: 2952 - protein, 40 aa, Artificial Sequence
  Description of Artificial Sequence: Synthetic polypeptide
DIARQTAQGMDYLHAKSIIHKDLKSNNIFLHEDLTVKIGD

SEQ ID NO: 2953 - protein, 40 aa, Artificial Sequence
  Description of Artificial Sequence: Synthetic polypeptide
DYLHAKSIIHRDLKSNIIFLHEDLTVKIGDFGLATVKSRW

SEQ ID NO: 2954 - protein, 40 aa, Artificial Sequence
  Description of Artificial Sequence: Synthetic polypeptide
AKSIIHRDLKSNIIFLHEDLTVKIGDFGLATVKSRWSGSH

SEQ ID NO: 2955 - protein, 40 aa, Artificial Sequence
  Description of Artificial Sequence: Synthetic polypeptide
SIIHRDLKSNIIFLHEDLTVKIGDFGLATVKSRWSGSHQF

SEQ ID NO: 2956 - protein, 40 aa, Artificial Sequence
  Description of Artificial Sequence: Synthetic polypeptide
IHRDLKSNIIFLHEDLTVKIGDFGLATVKSRWSGSHQFEQ

SEQ ID NO: 2957 - protein, 40 aa, Artificial Sequence
  Description of Artificial Sequence: Synthetic polypeptide
DLKSNIIFLHEDLTVKIGDFGLATVKSRWSGSHQFEQLSG

SEQ ID NO: 2958 - protein, 40 aa, Artificial Sequence
  Description of Artificial Sequence: Synthetic polypeptide
LKSNIIFLHEDLTVKIGDFGLATVKSRWSGSHQFEQLSGS

SEQ ID NO: 2959 - protein, 40 aa, Artificial Sequence
  Description of Artificial Sequence: Synthetic polypeptide
NIIFLHEDLTVKIGDFGLATVKSRWSGSHQFEQLSGSILW

SEQ ID NO: 2960 - protein, 40 aa, Artificial Sequence
  Description of Artificial Sequence: Synthetic polypeptide
IIFLHEDLTVKIGDFGLATVKSRWSGSHQFEQLSGSILWM

SEQ ID NO: 2961 - protein, 40 aa, Artificial Sequence
  Description of Artificial Sequence: Synthetic polypeptide
DIARQTAQGMDYLHAKSIIHRDLKSNNIFLHEDLTVKIGG

SEQ ID NO: 2962 - protein, 40 aa, Artificial Sequence
  Description of Artificial Sequence: Synthetic polypeptide
YLHAKSIIHRDLKSNNIFLHEDLTVKIGGFGLATVKSRWS

SEQ ID NO: 2963 - protein, 40 aa, Artificial Sequence
  Description of Artificial Sequence: Synthetic polypeptide
LHAKSIIHRDLKSNNIFLHEDLTVKIGGFGLATVKSRWSG

SEQ ID NO: 2964 - protein, 40 aa, Artificial Sequence
  Description of Artificial Sequence: Synthetic polypeptide
HAKSIIHRDLKSNNIFLHEDLTVKIGGFGLATVKSRWSGS

SEQ ID NO: 2965 - protein, 40 aa, Artificial Sequence
  Description of Artificial Sequence: Synthetic polypeptide
IFLHEDLTVKIGNFGLATVKSRWSGSHQFEQLSGSILWMA

SEQ ID NO: 2966 - protein, 40 aa, Artificial Sequence
  Description of Artificial Sequence: Synthetic polypeptide
EDLTVKIGNFGLATVKSRWSGSHQFEQLSGSILWMAPEVI

SEQ ID NO: 2967 - protein, 40 aa, Artificial Sequence
  Description of Artificial Sequence: Synthetic polypeptide
DLTVKIGNFGLATVKSRWSGSHQFEQLSGSILWMAPEVIR

SEQ ID NO: 2968 - protein, 40 aa, Artificial Sequence
  Description of Artificial Sequence: Synthetic polypeptide
LHAKSIIHRDLKSNNIFLHEDLTVKIGDFDLATVKSRWSG

SEQ ID NO: 2969 - protein, 40 aa, Artificial Sequence
  Description of Artificial Sequence: Synthetic polypeptide
HRDLKSNNIFLHEDLTVKIGDFDLATVKSRWSGSHQFEQL

SEQ ID NO: 2970 - protein, 40 aa, Artificial Sequence
  Description of Artificial Sequence: Synthetic polypeptide
NIFLHEDLTVKIGDFDLATVKSRWSGSHQFEQLSGSILWM

SEQ ID NO: 2971 - protein, 40 aa, Artificial Sequence
  Description of Artificial Sequence: Synthetic polypeptide
HAKSIIHRDLKSNNIFLHEDLTVKIGDFSLATVKSRWSGS

SEQ ID NO: 2972 - protein, 40 aa, Artificial Sequence
  Description of Artificial Sequence: Synthetic polypeptide
IFLHEDLTVKIGDFGQATVKSRWSGSHQFEQLSGSILWMA

SEQ ID NO: 2973 - protein, 40 aa, Artificial Sequence
  Description of Artificial Sequence: Synthetic polypeptide
HAKSIIHRDLKSNNIFLHEDLTVKIGDFGVATVKSRWSGS

SEQ ID NO: 2974 - protein, 40 aa, Artificial Sequence
  Description of Artificial Sequence: Synthetic polypeptide
NIFLHEDLTVKIGDFGVATVKSRWSGSHQFEQLSGSILWM

SEQ ID NO: 2975 - protein, 40 aa, Artificial Sequence
  Description of Artificial Sequence: Synthetic polypeptide
GQEAPIYELTSQFTGLKCPSLAGKPKVFFIQACQGDNYQK

SEQ ID NO: 2976 - protein, 40 aa, Artificial Sequence
  Description of Artificial Sequence: Synthetic polypeptide
ELTSQFTGLKCPSLAGKPKVFFIQACQGDNYQKGIPVETD

SEQ ID NO: 2977 - protein, 40 aa, Artificial Sequence
  Description of Artificial Sequence: Synthetic polypeptide
SQFTGLKCPSLAGKPKVFFIQACQGDNYQKGIPVETDSEE

SEQ ID NO: 2978 - protein, 40 aa, Artificial Sequence
  Description of Artificial Sequence: Synthetic polypeptide
GLKCPSLAGKPKVFFIQACQGDNYQKGIPVETDSEEQPYL

SEQ ID NO: 2979 - protein, 40 aa, Artificial Sequence
  Description of Artificial Sequence: Synthetic polypeptide
LKCPSLAGKPKVFFIQACQGDNYQKGIPVETDSEEQPYLE

SEQ ID NO: 2980 - protein, 40 aa, Artificial Sequence
  Description of Artificial Sequence: Synthetic polypeptide
KPKVFFIQACQGDNYQKGIPVETDSEEQPYLEMDLSSPQT

SEQ ID NO: 2981 - protein, 40 aa, Artificial Sequence
  Description of Artificial Sequence: Synthetic polypeptide
LKCPSLAGKPKVFFIQACQGDNYQGGIPVETDSEEQPYLE

SEQ ID NO: 2982 - protein, 40 aa, Artificial Sequence
  Description of Artificial Sequence: Synthetic polypeptide
KVTEPLDGERIATYTLFSHAVSSNGNAVEDPMEILITVTD

SEQ ID NO: 2983 - protein, 40 aa, Artificial Sequence
  Description of Artificial Sequence: Synthetic polypeptide
IIHRDLKPENVLLSSQEEDCLIKITDFGHSKILGETSLRR

SEQ ID NO: 2984 - protein, 40 aa, Artificial Sequence
  Description of Artificial Sequence: Synthetic polypeptide
LKPENVLLSSQEEDCLIKITDFGHSKILGETSLRRTLCGT

SEQ ID NO: 2985 - protein, 40 aa, Artificial Sequence
  Description of Artificial Sequence: Synthetic polypeptide
KPENVLLSSQEEDCLIKITDFGHSKILGETSLRRTLCGTP

SEQ ID NO: 2986 - protein, 40 aa, Artificial Sequence
  Description of Artificial Sequence: Synthetic polypeptide
LLSSQEEDCLIKITDFGHSKILGETSLRRTLCGTPTYLAP

SEQ ID NO: 2987 - protein, 40 aa, Artificial Sequence
  Description of Artificial Sequence: Synthetic polypeptide
LSSQEEDCLIKITDFGHSKILGETSLRRTLCGTPTYLAPE

SEQ ID NO: 2988 - protein, 40 aa, Artificial Sequence
  Description of Artificial Sequence: Synthetic polypeptide
SSQEEDCLIKITDFGHSKILGETSLRRTLCGTPTYLAPEV

SEQ ID NO: 2989 - protein, 40 aa, Artificial Sequence
  Description of Artificial Sequence: Synthetic polypeptide
ITDFGHSKILGETSLRRTLCGTPTYLAPEVLVSVGTAGYN

SEQ ID NO: 2990 - protein, 40 aa, Artificial Sequence
  Description of Artificial Sequence: Synthetic polypeptide
TDFGHSKILGETSLRRTLCGTPTYLAPEVLVSVGTAGYNR

SEQ ID NO: 2991 - protein, 40 aa, Artificial Sequence
  Description of Artificial Sequence: Synthetic polypeptide
GETSLRRTLCGTPTYLAPEVLVSVGTAGYNRAVDCWSLGV

SEQ ID NO: 2992 - protein, 40 aa, Artificial Sequence
  Description of Artificial Sequence: Synthetic polypeptide
KPENVLLSSQEEDCLIKITDFGHSKILGETSLMRTLCGTL

SEQ ID NO: 2993 - protein, 40 aa, Artificial Sequence
  Description of Artificial Sequence: Synthetic polypeptide
PENVLLSSQEEDCLIKITDFGHSKILGETSLMRTLCGTLT

SEQ ID NO: 2994 - protein, 40 aa, Artificial Sequence
  Description of Artificial Sequence: Synthetic polypeptide
SSQEEDCLIKITDFGHSKILGETSLMRTLCGTLTYLAPEV

SEQ ID NO: 2995 - protein, 40 aa, Artificial Sequence
  Description of Artificial Sequence: Synthetic polypeptide
TDFGHSKILGETSLMRTLCGTLTYLAPEVLVSVGTAGYNR

SEQ ID NO: 2996 - protein, 40 aa, Artificial Sequence
  Description of Artificial Sequence: Synthetic polypeptide
SKILGETSLMRTLCGTLTYLAPEVLVSVGTAGYNRAVDCW

SEQ ID NO: 2997 - protein, 40 aa, Artificial Sequence
  Description of Artificial Sequence: Synthetic polypeptide
KPENVLLSSQEEDCLIKITDFGHSKILGETSLMRTLCGTY

SEQ ID NO: 2998 - protein, 40 aa, Artificial Sequence
  Description of Artificial Sequence: Synthetic polypeptide
PENVLLSSQEEDCLIKITDFGHSKILGETSLMRTLCGTYT

SEQ ID NO: 2999 - protein, 40 aa, Artificial Sequence
  Description of Artificial Sequence: Synthetic polypeptide
TDFGHSKILGETSLMRTLCGTYTYLAPEVLVSVGTAGYNR

SEQ ID NO: 3000 - protein, 40 aa, Artificial Sequence
  Description of Artificial Sequence: Synthetic polypeptide
SKILGETSLMRTLCGTYTYLAPEVLVSVGTAGYNRAVDCW

SEQ ID NO: 3001 - protein, 40 aa, Artificial Sequence
  Description of Artificial Sequence: Synthetic polypeptide
KITDFGHSKILGETSLMRTLCGTPHYLAPEVLVSVGTAGY

SEQ ID NO: 3002 - protein, 40 aa, Artificial Sequence
  Description of Artificial Sequence: Synthetic polypeptide
TDFGHSKILGETSLMRTLCGTPHYLAPEVLVSVGTAGYNR

SEQ ID NO: 3003 - protein, 40 aa, Artificial Sequence
  Description of Artificial Sequence: Synthetic polypeptide
GETSLMRTLCGTPHYLAPEVLVSVGTAGYNRAVDCWSLGV

SEQ ID NO: 3004 - protein, 40 aa, Artificial Sequence
  Description of Artificial Sequence: Synthetic polypeptide
NRAVDCWSLGFILFICLSGYPPFSEHRTQVSLKDQITSGK

SEQ ID NO: 3005 - protein, 40 aa, Artificial Sequence
  Description of Artificial Sequence: Synthetic polypeptide
AVDCWSLGFILFICLSGYPPFSEHRTQVSLKDQITSGKYN

SEQ ID NO: 3006 - protein, 40 aa, Artificial Sequence
  Description of Artificial Sequence: Synthetic polypeptide
WSLGFILFICLSGYPPFSEHRTQVSLKDQITSGKYNFIPE

SEQ ID NO: 3007 - protein, 40 aa, Artificial Sequence
  Description of Artificial Sequence: Synthetic polypeptide
LKDQITSGKYNFIPEVGAEVSEKALDLVKKLLVVDPKARF

SEQ ID NO: 3008 - protein, 40 aa, Artificial Sequence
  Description of Artificial Sequence: Synthetic polypeptide
ITSGKYNFIPEVGAEVSEKALDLVKKLLVVDPKARFTTEE

SEQ ID NO: 3009 - protein, 40 aa, Artificial Sequence
  Description of Artificial Sequence: Synthetic polypeptide
FIPEVGAEVSEKALDLVKKLLVVDPKARFTTEEALRHPWL

SEQ ID NO: 3010 - protein, 40 aa, Artificial Sequence
  Description of Artificial Sequence: Synthetic polypeptide
SKLIILASGGPQALVNIMRTYTFEKLLWTTSRVLKVLSVC

SEQ ID NO: 3011 - protein, 40 aa, Artificial Sequence
  Description of Artificial Sequence: Synthetic polypeptide
KLIILASGGPQALVNIMRTYTFEKLLWTTSRVLKVLSVCS

SEQ ID NO: 3012 - protein, 40 aa, Artificial Sequence
  Description of Artificial Sequence: Synthetic polypeptide
LIILASGGPQALVNIMRTYTFEKLLWTTSRVLKVLSVCSS

SEQ ID NO: 3013 - protein, 40 aa, Artificial Sequence
  Description of Artificial Sequence: Synthetic polypeptide
QALVNIMRTYTFEKLLWTTSRVLKVLSVCSSNKPAIVEAG

SEQ ID NO: 3014 - protein, 40 aa, Artificial Sequence
  Description of Artificial Sequence: Synthetic polypeptide
NIMRTYTFEKLLWTTSRVLKVLSVCSSNKPAIVEAGGMQA

SEQ ID NO: 3015 - protein, 40 aa, Artificial Sequence
  Description of Artificial Sequence: Synthetic polypeptide
SKLIILASGGPQALVNIMRTYTYKKLLWTTSRVLKVLSVC

SEQ ID NO: 3016 - protein, 40 aa, Artificial Sequence
  Description of Artificial Sequence: Synthetic polypeptide
LIILASGGPQALVNIMRTYTYKKLLWTTSRVLKVLSVCSS

SEQ ID NO: 3017 - protein, 40 aa, Artificial Sequence
  Description of Artificial Sequence: Synthetic polypeptide
ASGGPQALVNIMRTYTYKKLLWTTSRVLKVLSVCSSNKPA

SEQ ID NO: 3018 - protein, 40 aa, Artificial Sequence
  Description of Artificial Sequence: Synthetic polypeptide
NIMRTYTYKKLLWTTSRVLKVLSVCSSNKPAIVEAGGMQA

SEQ ID NO: 3019 - protein, 40 aa, Artificial Sequence
  Description of Artificial Sequence: Synthetic polypeptide
IMRTYTYKKLLWTTSRVLKVLSVCSSNKPAIVEAGGMQAL

SEQ ID NO: 3020 - protein, 40 aa, Artificial Sequence
  Description of Artificial Sequence: Synthetic polypeptide
KLIILASGGPQALVNIMRTYTYETLLWTTSRVLKVLSVCS

SEQ ID NO: 3021 - protein, 40 aa, Artificial Sequence
  Description of Artificial Sequence: Synthetic polypeptide
PQALVNIMRTYTYETLLWTTSRVLKVLSVCSSNKPAIVEA

SEQ ID NO: 3022 - protein, 40 aa, Artificial Sequence
  Description of Artificial Sequence: Synthetic polypeptide
NIMRTYTYETLLWTTSRVLKVLSVCSSNKPAIVEAGGMQA

SEQ ID NO: 3023 - protein, 40 aa, Artificial Sequence
  Description of Artificial Sequence: Synthetic polypeptide
RILSDAATKQEGMEGLLGTLVQLLGSDDINVVTCAAGILS

SEQ ID NO: 3024 - protein, 40 aa, Artificial Sequence
  Description of Artificial Sequence: Synthetic polypeptide
NCLWTLRKLSDAATKQEGMEGLLGTLVQLLGSDDINVVTC

SEQ ID NO: 3025 - protein, 40 aa, Artificial Sequence
  Description of Artificial Sequence: Synthetic polypeptide
RKLSDAATKQEGMEGLLGTLVQLLGSDDINVVTCAAGILS

SEQ ID NO: 3026 - protein, 40 aa, Artificial Sequence
  Description of Artificial Sequence: Synthetic polypeptide
QNCLWTLRYLSDAATKQEGMEGLLGTLVQLLGSDDINVVT

SEQ ID NO: 3027 - protein, 40 aa, Artificial Sequence
  Description of Artificial Sequence: Synthetic polypeptide
NCLWTLRYLSDAATKQEGMEGLLGTLVQLLGSDDINVVTC

SEQ ID NO: 3028 - protein, 40 aa, Artificial Sequence
  Description of Artificial Sequence: Synthetic polypeptide
CLWTLRYLSDAATKQEGMEGLLGTLVQLLGSDDINVVTCA

SEQ ID NO: 3029 - protein, 40 aa, Artificial Sequence
  Description of Artificial Sequence: Synthetic polypeptide
TLRYLSDAATKQEGMEGLLGTLVQLLGSDDINVVTCAAGI

SEQ ID NO: 3030 - protein, 40 aa, Artificial Sequence
  Description of Artificial Sequence: Synthetic polypeptide
RYLSDAATKQEGMEGLLGTLVQLLGSDDINVVTCAAGILS

SEQ ID NO: 3031 - protein, 40 aa, Artificial Sequence
  Description of Artificial Sequence: Synthetic polypeptide
NLSDAATKQEGMEGLLGTLVQLLGSDDINVVTCAAGILSD

SEQ ID NO: 3032 - protein, 40 aa, Artificial Sequence
  Description of Artificial Sequence: Synthetic polypeptide
LVQLLGSDDINVVTCAAGILSDLTCNNYKNKMMVCQVGGI

SEQ ID NO: 3033 - protein, 40 aa, Artificial Sequence
  Description of Artificial Sequence: Synthetic polypeptide
LGSDDINVVTCAAGILSDLTCNNYKNKMMVCQVGGIEALV

SEQ ID NO: 3034 - protein, 40 aa, Artificial Sequence
  Description of Artificial Sequence: Synthetic polypeptide
SDDINVVTCAAGILSDLTCNNYKNKMMVCQVGGIEALVRT

SEQ ID NO: 3035 - protein, 40 aa, Artificial Sequence
  Description of Artificial Sequence: Synthetic polypeptide
DDINVVTCAAGILSDLTCNNYKNKMMVCQVGGIEALVRTV

SEQ ID NO: 3036 - protein, 40 aa, Artificial Sequence
  Description of Artificial Sequence: Synthetic polypeptide
DINVVTCAAGILSDLTCNNYKNKMMVCQVGGIEALVRTVL

SEQ ID NO: 3037 - protein, 40 aa, Artificial Sequence
  Description of Artificial Sequence: Synthetic polypeptide
INVVTCAAGILSDLTCNNYKNKMMVCQVGGIEALVRTVLR

SEQ ID NO: 3038 - protein, 40 aa, Artificial Sequence
  Description of Artificial Sequence: Synthetic polypeptide
VVTCAAGILSDLTCNNYKNKMMVCQVGGIEALVRTVLRAG

SEQ ID NO: 3039 - protein, 40 aa, Artificial Sequence
  Description of Artificial Sequence: Synthetic polypeptide
TCAAGILSDLTCNNYKNKMMVCQVGGIEALVRTVLRAGDR

SEQ ID NO: 3040 - protein, 40 aa, Artificial Sequence
  Description of Artificial Sequence: Synthetic polypeptide
ISNVKHVINFDLPSDIEEYVHRIGRAGRVGNLGLATSFFN

SEQ ID NO: 3041 - protein, 40 aa, Artificial Sequence
  Description of Artificial Sequence: Synthetic polypeptide
PSDIEEYVHRIGRAGRVGNLGLATSFFNERNINITKDLLD

SEQ ID NO: 3042 - protein, 40 aa, Artificial Sequence
  Description of Artificial Sequence: Synthetic polypeptide
PSDIEEYVHRIGRMGRVGNLGLATSFFNERNINITKDLLD

SEQ ID NO: 3043 - protein, 40 aa, Artificial Sequence
  Description of Artificial Sequence: Synthetic polypeptide
LLQAFTHASYHYNTITDCYQSLEFLGDAILDYLITKHLYE

SEQ ID NO: 3044 - protein, 40 aa, Artificial Sequence
  Description of Artificial Sequence: Synthetic polypeptide
FEKKINYRFKNKAYLLQAFTHASYHYNTITDCYQRLKFLG

SEQ ID NO: 3045 - protein, 40 aa, Artificial Sequence
  Description of Artificial Sequence: Synthetic polypeptide
KKINYRFKNKAYLLQAFTHASYHYNTITDCYQRLKFLGDA

SEQ ID NO: 3046 - protein, 40 aa, Artificial Sequence
  Description of Artificial Sequence: Synthetic polypeptide
KINYRFKNKAYLLQAFTHASYHYNTITDCYQRLKFLGDAI

SEQ ID NO: 3047 - protein, 40 aa, Artificial Sequence
  Description of Artificial Sequence: Synthetic polypeptide
INYRFKNKAYLLQAFTHASYHYNTITDCYQRLKFLGDAIL

SEQ ID NO: 3048 - protein, 40 aa, Artificial Sequence
  Description of Artificial Sequence: Synthetic polypeptide
RFKNKAYLLQAFTHASYHYNTITDCYQRLKFLGDAILDYL

SEQ ID NO: 3049 - protein, 40 aa, Artificial Sequence
  Description of Artificial Sequence: Synthetic polypeptide
FKNKAYLLQAFTHASYHYNTITDCYQRLKFLGDAILDYLI

SEQ ID NO: 3050 - protein, 40 aa, Artificial Sequence
  Description of Artificial Sequence: Synthetic polypeptide
KAYLLQAFTHASYHYNTITDCYQRLKFLGDAILDYLITKH

SEQ ID NO: 3051 - protein, 40 aa, Artificial Sequence
  Description of Artificial Sequence: Synthetic polypeptide
LQAFTHASYHYNTITDCYQRLKFLGDAILDYLITKHLYED

SEQ ID NO: 3052 - protein, 40 aa, Artificial Sequence
  Description of Artificial Sequence: Synthetic polypeptide
KKINYRFKNKAYLLQAFTHASYHYNTITDCYQRLEFLGNA

SEQ ID NO: 3053 - protein, 40 aa, Artificial Sequence
  Description of Artificial Sequence: Synthetic polypeptide
KINYRFKNKAYLLQAFTHASYHYNTITDCYQRLEFLGNAI

SEQ ID NO: 3054 - protein, 40 aa, Artificial Sequence
  Description of Artificial Sequence: Synthetic polypeptide
YRFKNKAYLLQAFTHASYHYNTITDCYQRLEFLGNAILDY

SEQ ID NO: 3055 - protein, 40 aa, Artificial Sequence
  Description of Artificial Sequence: Synthetic polypeptide
LLQAFTHASYHYNTITDCYQRLEFLGNAILDYLITKHLYE

SEQ ID NO: 3056 - protein, 40 aa, Artificial Sequence
  Description of Artificial Sequence: Synthetic polypeptide
IEVPNAMGDIFESLAGAIYMDSGMSLETVWQVYYPMMRPL

SEQ ID NO: 3057 - protein, 40 aa, Artificial Sequence
  Description of Artificial Sequence: Synthetic polypeptide
VIFESLAGAIYMDSGMSLETVWQVYYPMMRPLIEKFSANV

SEQ ID NO: 3058 - protein, 40 aa, Artificial Sequence
  Description of Artificial Sequence: Synthetic polypeptide
MGYIFESLAGAIYMDSGMSLETVWQVYYPMMRPLIEKFSA

SEQ ID NO: 3059 - protein, 40 aa, Artificial Sequence
  Description of Artificial Sequence: Synthetic polypeptide
DIFDSLAGAIYMDSGMSLETVWQVYYPMMRPLIEKFSANV

SEQ ID NO: 3060 - protein, 40 aa, Artificial Sequence
  Description of Artificial Sequence: Synthetic polypeptide
NTVERIPLENLQIIGGNMYYENSYALAVLSNYDANKTGLK

SEQ ID NO: 3061 - protein, 40 aa, Artificial Sequence
  Description of Artificial Sequence: Synthetic polypeptide
VERIPLENLQIIGGNMYYENSYALAVLSNYDANKTGLKEL

SEQ ID NO: 3062 - protein, 40 aa, Artificial Sequence
  Description of Artificial Sequence: Synthetic polypeptide
LQIIGGNMYYENSYALAVLSNYDANKTGLKELPMRNLQEI

SEQ ID NO: 3063 - protein, 40 aa, Artificial Sequence
  Description of Artificial Sequence: Synthetic polypeptide
QIIGGNMYYENSYALAVLSNYDANKTGLKELPMRNLQEIL

SEQ ID NO: 3064 - protein, 40 aa, Artificial Sequence
  Description of Artificial Sequence: Synthetic polypeptide
IIGGNMYYENSYALAVLSNYDANKTGLKELPMRNLQEILH

SEQ ID NO: 3065 - protein, 40 aa, Artificial Sequence
  Description of Artificial Sequence: Synthetic polypeptide
IGGNMYYENSYALAVLSNYDANKTGLKELPMRNLQEILHG

SEQ ID NO: 3066 - protein, 40 aa, Artificial Sequence
  Description of Artificial Sequence: Synthetic polypeptide
IALNTVERIPLENLQIIKGNMYYENSYALAVLSNYDANKT

SEQ ID NO: 3067 - protein, 40 aa, Artificial Sequence
  Description of Artificial Sequence: Synthetic polypeptide
IPLENLQIIKGNMYYENSYALAVLSNYDANKTGLKELPMR

SEQ ID NO: 3068 - protein, 40 aa, Artificial Sequence
  Description of Artificial Sequence: Synthetic polypeptide
NLQIIKGNMYYENSYALAVLSNYDANKTGLKELPMRNLQE

SEQ ID NO: 3069 - protein, 40 aa, Artificial Sequence
  Description of Artificial Sequence: Synthetic polypeptide
IKGNMYYENSYALAVLSNYDANKTGLKELPMRNLQEILHG

SEQ ID NO: 3070 - protein, 40 aa, Artificial Sequence
  Description of Artificial Sequence: Synthetic polypeptide
QERELVEPLTPSGEAPNQALLRILKETEFKKIKVLCSGAF

SEQ ID NO: 3071 - protein, 40 aa, Artificial Sequence
  Description of Artificial Sequence: Synthetic polypeptide
ELVEPLTPSGEAPNQALLRILKETEFKKIKVLGSGAFSTV

SEQ ID NO: 3072 - protein, 40 aa, Artificial Sequence
  Description of Artificial Sequence: Synthetic polypeptide
GEAPNQALLRILKETEFKKIKVLGSGAFSTVYKGLWIPEG

SEQ ID NO: 3073 - protein, 40 aa, Artificial Sequence
  Description of Artificial Sequence: Synthetic polypeptide
LGSGAFSTVYKGLWIPEGEKVKIPVAIKELREATSPKANK

SEQ ID NO: 3074 - protein, 40 aa, Artificial Sequence
  Description of Artificial Sequence: Synthetic polypeptide
GLWIPEGEKVKIPVAIKELREATSPKANKENLDEAYVMAS

SEQ ID NO: 3075 - protein, 40 aa, Artificial Sequence
  Description of Artificial Sequence: Synthetic polypeptide
LWIPEGEKVKIPVAIKELREATSPKANKENLDEAYVMASV

SEQ ID NO: 3076 - protein, 40 aa, Artificial Sequence
  Description of Artificial Sequence: Synthetic polypeptide
KVKIPVAIKELREATSPKANKENLDEAYVMASVDNPHVCR

SEQ ID NO: 3077 - protein, 40 aa, Artificial Sequence
  Description of Artificial Sequence: Synthetic polypeptide
VKIPVAIKELREATSPKANKENLDEAYVMASVDNPHVCRL

SEQ ID NO: 3078 - protein, 40 aa, Artificial Sequence
  Description of Artificial Sequence: Synthetic polypeptide
LQRMFNNCEVVLGNLEITYVQRNYDLSFLKTIQEMAGYVL

SEQ ID NO: 3079 - protein, 40 aa, Artificial Sequence
  Description of Artificial Sequence: Synthetic polypeptide
RMFNNCEVVLGNLEITYVQRNYDLSFLKTIQEMAGYVLIA

SEQ ID NO: 3080 - protein, 40 aa, Artificial Sequence
  Description of Artificial Sequence: Synthetic polypeptide
MFNNCEVVLGNLEITYVQRNYDLSFLKTIQEMAGYVLIAL

SEQ ID NO: 3081 - protein, 40 aa, Artificial Sequence
  Description of Artificial Sequence: Synthetic polypeptide
FNNCEVVLGNLEITYVQRNYDLSFLKTIQEMAGYVLIALN

SEQ ID NO: 3082 - protein, 40 aa, Artificial Sequence
  Description of Artificial Sequence: Synthetic polypeptide
VVLGNLEITYVQRNYDLSFLKTIQEMAGYVLIALNTVERI

SEQ ID NO: 3083 - protein, 40 aa, Artificial Sequence
  Description of Artificial Sequence: Synthetic polypeptide
SDCPPPNQRRVYISDLDSVHFFRPKCLRTAVYHEILIGYL

SEQ ID NO: 3084 - protein, 40 aa, Artificial Sequence
  Description of Artificial Sequence: Synthetic polypeptide
CPPPNQRRVYISDLDSVHFFRPKCLRTAVYHEILIGYLEY

SEQ ID NO: 3085 - protein, 40 aa, Artificial Sequence
  Description of Artificial Sequence: Synthetic polypeptide
RRVYISDLDSVHFFRPKCLRTAVYHEILIGYLEYVKKLGY

SEQ ID NO: 3086 - protein, 40 aa, Artificial Sequence
  Description of Artificial Sequence: Synthetic polypeptide
YISDLDSVHFFRPKCLRTAVYHEILIGYLEYVKKLGYTTG

SEQ ID NO: 3087 - protein, 40 aa, Artificial Sequence
  Description of Artificial Sequence: Synthetic polypeptide
GSDCPPPNQRRVYISYPDSVHFFRPKCLRTAVYHEILIGY

SEQ ID NO: 3088 - protein, 40 aa, Artificial Sequence
  Description of Artificial Sequence: Synthetic polypeptide
SDCPPPNQRRVYISYPDSVHFFRPKCLRTAVYHEILIGYL

SEQ ID NO: 3089 - protein, 40 aa, Artificial Sequence
  Description of Artificial Sequence: Synthetic polypeptide
RRVYISYPDSVHFFRPKCLRTAVYHEILIGYLEYVKKLGY

SEQ ID NO: 3090 - protein, 40 aa, Artificial Sequence
  Description of Artificial Sequence: Synthetic polypeptide
YISYPDSVHFFRPKCLRTAVYHEILIGYLEYVKKLGYTTG

SEQ ID NO: 3091 - protein, 40 aa, Artificial Sequence
  Description of Artificial Sequence: Synthetic polypeptide
ISYPDSVHFFRPKCLRTAVYHEILIGYLEYVKKLGYTTGH

SEQ ID NO: 3092 - protein, 40 aa, Artificial Sequence
  Description of Artificial Sequence: Synthetic polypeptide
QRRVYISYLNSVHFFRPKCLRTAVYHEILIGYLEYVKKLG

SEQ ID NO: 3093 - protein, 40 aa, Artificial Sequence
  Description of Artificial Sequence: Synthetic polypeptide
RRVYISYLNSVHFFRPKCLRTAVYHEILIGYLEYVKKLGY

SEQ ID NO: 3094 - protein, 40 aa, Artificial Sequence
  Description of Artificial Sequence: Synthetic polypeptide
YISYLDIVHFFRPKCLRTAVYHEILIGYLEYVKKLGYTTG

SEQ ID NO: 3095 - protein, 40 aa, Artificial Sequence
  Description of Artificial Sequence: Synthetic polypeptide
ISYLDIVHFFRPKCLRTAVYHEILIGYLEYVKKLGYTTGH

SEQ ID NO: 3096 - protein, 40 aa, Artificial Sequence
  Description of Artificial Sequence: Synthetic polypeptide
RRVYISYLDSVHFFRPKCLRTAVCHEILIGYLEYVKKLGY

SEQ ID NO: 3097 - protein, 40 aa, Artificial Sequence
  Description of Artificial Sequence: Synthetic polypeptide
RVYISYLDSVHFFRPKCLRTAVCHEILIGYLEYVKKLGYT

SEQ ID NO: 3098 - protein, 40 aa, Artificial Sequence
  Description of Artificial Sequence: Synthetic polypeptide
YISYLDSVHFFRPKCLRTAVCHEILIGYLEYVKKLGYTTG

SEQ ID NO: 3099 - protein, 40 aa, Artificial Sequence
  Description of Artificial Sequence: Synthetic polypeptide
ISYLDSVHFFRPKCLRTAVCHEILIGYLEYVKKLGYTTGH

SEQ ID NO: 3100 - protein, 40 aa, Artificial Sequence
  Description of Artificial Sequence: Synthetic polypeptide
FRPKCLRTAVCHEILIGYLEYVKKLGYTTGHIWACPPSEG

SEQ ID NO: 3101 - protein, 40 aa, Artificial Sequence
  Description of Artificial Sequence: Synthetic polypeptide
SDCPPPNQRRVYISYLDSVHFFRPKCLRTAVDHEILIGYL

SEQ ID NO: 3102 - protein, 40 aa, Artificial Sequence
  Description of Artificial Sequence: Synthetic polypeptide
RVYISYLDSVHFFRPKCLRTAVDHEILIGYLEYVKKLGYT

SEQ ID NO: 3103 - protein, 40 aa, Artificial Sequence
  Description of Artificial Sequence: Synthetic polypeptide
VDHEILIGYLEYVKKLGYTTGHIWACPPSEGDDYIFHCHP

SEQ ID NO: 3104 - protein, 40 aa, Artificial Sequence
  Description of Artificial Sequence: Synthetic polypeptide
VKKLGYTTGHIWACPPSEGDDYIFHCPPPDQKIPKPKRLQ

SEQ ID NO: 3105 - protein, 40 aa, Artificial Sequence
  Description of Artificial Sequence: Synthetic polypeptide
YTTGHIWACPPSEGDDYIFHCPPPDQKIPKPKRLQEWYKK

SEQ ID NO: 3106 - protein, 40 aa, Artificial Sequence
  Description of Artificial Sequence: Synthetic polypeptide
ETELRKVKVLGSGAFGTVYKGIWIPDGENVKIPVAIKVMR

SEQ ID NO: 3107 - protein, 40 aa, Artificial Sequence
  Description of Artificial Sequence: Synthetic polypeptide
KIPVAIKVMRENTSPKANKEILDEAYVMAGVGSPYVSRLL

SEQ ID NO: 3108 - protein, 40 aa, Artificial Sequence
  Description of Artificial Sequence: Synthetic polypeptide
PVAIKILNETTGPKANVEFMDEALIMASMDHPHLVRLLRV

SEQ ID NO: 3109 - protein, 40 aa, Artificial Sequence
  Description of Artificial Sequence: Synthetic polypeptide
VAIKILNETTGPKANVEFMDEALIMASMDHPHLVRLLRVC

SEQ ID NO: 3110 - protein, 40 aa, Artificial Sequence
  Description of Artificial Sequence: Synthetic polypeptide
AIKILNETTGPKANVEFMDEALIMASMDHPHLVRLLVVCL

SEQ ID NO: 3111 - protein, 40 aa, Artificial Sequence
  Description of Artificial Sequence: Synthetic polypeptide
LHEKRVVSGSRDATLRVWDIETGQCLHVLMGHVAAVRLVQ

SEQ ID NO: 3112 - protein, 40 aa, Artificial Sequence
  Description of Artificial Sequence: Synthetic polypeptide
EKRVVSGSRDATLRVWDIETGQCLHVLMGHVAAVRLVQYD

SEQ ID NO: 3113 - protein, 40 aa, Artificial Sequence
  Description of Artificial Sequence: Synthetic polypeptide
GSRDATLRVWDIETGQCLHVLMGHVAAVRLVQYDGRRVVS

SEQ ID NO: 3114 - protein, 40 aa, Artificial Sequence
  Description of Artificial Sequence: Synthetic polypeptide
RVWDIETGQCLHVLMGHVAAVRLVQYDGRRVVSGAYDFMV

SEQ ID NO: 3115 - protein, 40 aa, Artificial Sequence
  Description of Artificial Sequence: Synthetic polypeptide
ETGQCLHVLMGHVAAVRLVQYDGRRVVSGAYDFMVKVWDP

SEQ ID NO: 3116 - protein, 40 aa, Artificial Sequence
  Description of Artificial Sequence: Synthetic polypeptide
LVQYDGRRVVSGAYDFMVKVWDPETETCLHTLQGHTNRVY

SEQ ID NO: 3117 - protein, 40 aa, Artificial Sequence
  Description of Artificial Sequence: Synthetic polypeptide
RVVSGAYDFMVKVWDPETETCLHTLQGHTNRVCSLQFDGI

SEQ ID NO: 3118 - protein, 40 aa, Artificial Sequence
  Description of Artificial Sequence: Synthetic polypeptide
VSGAYDFMVKVWDPETETCLHTLQGHTNRVCSLQFDGIHV

SEQ ID NO: 3119 - protein, 40 aa, Artificial Sequence
  Description of Artificial Sequence: Synthetic polypeptide
GAYDFMVKVWDPETETCLHTLQGHTNRVCSLQFDGIHVVS

SEQ ID NO: 3120 - protein, 40 aa, Artificial Sequence
  Description of Artificial Sequence: Synthetic polypeptide
LQGHTNRVCSLQFDGIHVVSGSLDTSIRVWDVETGNCIHT

SEQ ID NO: 3121 - protein, 40 aa, Artificial Sequence
  Description of Artificial Sequence: Synthetic polypeptide
DGRRVVSGAYDFMVKVWDPETETCLHTLQGHTNRVHSLQF

SEQ ID NO: 3122 - protein, 40 aa, Artificial Sequence
  Description of Artificial Sequence: Synthetic polypeptide
VSGAYDFMVKVWDPETETCLHTLQGHTNRVHSLQFDGIHV

SEQ ID NO: 3123 - protein, 40 aa, Artificial Sequence
  Description of Artificial Sequence: Synthetic polypeptide
TGHQSLTLGMELKDNILVSGNADSTVKIWDIKTGQCLQTL

SEQ ID NO: 3124 - protein, 40 aa, Artificial Sequence
  Description of Artificial Sequence: Synthetic polypeptide
ANSTVKIWDIKTGQCLQTLQGPNKHQSAVTCLQFNKNFVI

SEQ ID NO: 3125 - protein, 40 aa, Artificial Sequence
  Description of Artificial Sequence: Synthetic polypeptide
ADSTVKIWDIKTGQCLQTLQGPNKHQCAVTCLQFNKNFVI

SEQ ID NO: 3126 - protein, 40 aa, Artificial Sequence
  Description of Artificial Sequence: Synthetic polypeptide
ATEKDLSDLVSEMEMMKMIGKQKNIINLLGACTQDGPLYV

SEQ ID NO: 3127 - protein, 40 aa, Artificial Sequence
  Description of Artificial Sequence: Synthetic polypeptide
EKDLSDLVSEMEMMKMIGKQKNIINLLGACTQDGPLYVIV

SEQ ID NO: 3128 - protein, 40 aa, Artificial Sequence
  Description of Artificial Sequence: Synthetic polypeptide
KDLSDLVSEMEMMKMIGKQKNIINLLGACTQDGPLYVIVE

SEQ ID NO: 3129 - protein, 40 aa, Artificial Sequence
  Description of Artificial Sequence: Synthetic polypeptide
MMKMIGKQKNIINLLGACTQDGPLYVIVEYASKGNLREYL

SEQ ID NO: 3130 - protein, 40 aa, Artificial Sequence
  Description of Artificial Sequence: Synthetic polypeptide
MKMIGKQKNIINLLGACTQDGPLYVIVEYASKGNLREYLR

SEQ ID NO: 3131 - protein, 40 aa, Artificial Sequence
  Description of Artificial Sequence: Synthetic polypeptide
RENLEFGKVLGLGAFGKVMNATAYGISKTGVSIQVAVKML

SEQ ID NO: 3132 - protein, 40 aa, Artificial Sequence
  Description of Artificial Sequence: Synthetic polypeptide
DVDRIATLGYLPTQQDVLRVCVPTTGIIEYPFDLENIIFR

SEQ ID NO: 3133 - protein, 40 aa, Artificial Sequence
  Description of Artificial Sequence: Synthetic polypeptide
IEYPFDLQSVIFRMVDVGGPRSERRKWIHCFENVTSIMFL

SEQ ID NO: 3134 - protein, 40 aa, Artificial Sequence
  Description of Artificial Sequence: Synthetic polypeptide
NVTSIMFLVALSEYDQVLVESDNENGMEESKALFRTIITY

SEQ ID NO: 3135 - protein, 40 aa, Artificial Sequence
  Description of Artificial Sequence: Synthetic polypeptide
VLVESDNENGMEESKALFRTIITYPWFQNSSVILFLNKKD

SEQ ID NO: 3136 - protein, 40 aa, Artificial Sequence
  Description of Artificial Sequence: Synthetic polypeptide
ENGMEESKALFRTIITYPWFQNSSVILFLNKKDLLEEKIM

SEQ ID NO: 3137 - protein, 40 aa, Artificial Sequence
  Description of Artificial Sequence: Synthetic polypeptide
SPGVVISDDEPGYDLDLFCIPNHYAEDLERVFIPHGLIMD

SEQ ID NO: 3138 - protein, 40 aa, Artificial Sequence
  Description of Artificial Sequence: Synthetic polypeptide
LIMDRTERLARDVMKEMGGHHIVALCVLKGGYKFFADLLD

SEQ ID NO: 3139 - protein, 40 aa, Artificial Sequence
  Description of Artificial Sequence: Synthetic polypeptide
HIVALCVLKGGYKFFADLLDYIKALNRNSDRSIPMTVDFI

SEQ ID NO: 3140 - protein, 40 aa, Artificial Sequence
  Description of Artificial Sequence: Synthetic polypeptide
ALCVLKGGYKFFADLLDYIKALNRNSDRSIPMTVDFIRLK

SEQ ID NO: 3141 - protein, 40 aa, Artificial Sequence
  Description of Artificial Sequence: Synthetic polypeptide
ADLLDYIKALNRNSDRSIPMTVDFIRLKSYCNDQSTGDIK

SEQ ID NO: 3142 - protein, 40 aa, Artificial Sequence
  Description of Artificial Sequence: Synthetic polypeptide
GDIKVIGGDDLSTLTGKNVLIVEDIIDTGKTMQTLLSLVR

SEQ ID NO: 3143 - protein, 40 aa, Artificial Sequence
  Description of Artificial Sequence: Synthetic polypeptide
IKVIGGDDLSTLTGKNVLIVEDIIDTGKTMQTLLSLVRQY

SEQ ID NO: 3144 - protein, 40 aa, Artificial Sequence
  Description of Artificial Sequence: Synthetic polypeptide
KVIGGDDLSTLTGKNVLIVEDIIDTGKTMQTLLSLVRQYN

SEQ ID NO: 3145 - protein, 40 aa, Artificial Sequence
  Description of Artificial Sequence: Synthetic polypeptide
RSVGYKPDFVGFEIPDKFVVGYALDYNEYFRDLNHVCVIS

SEQ ID NO: 3146 - protein, 40 aa, Artificial Sequence
  Description of Artificial Sequence: Synthetic polypeptide
SVGYKPDFVGFEIPDKFVVGYALDYNEYFRDLNHVCVISE

SEQ ID NO: 3147 - protein, 40 aa, Artificial Sequence
  Description of Artificial Sequence: Synthetic polypeptide
VVVGAVGVGKSALTIQLIQNHFVDEYDPTIEDSYRKQVVI

SEQ ID NO: 3148 - protein, 40 aa, Artificial Sequence
  Description of Artificial Sequence: Synthetic polypeptide
VVVGAGRVGKSALTIQLIQNHFVDEYDPTIEDSYRKQVVI

SEQ ID NO: 3149 - protein, 40 aa, Artificial Sequence
  Description of Artificial Sequence: Synthetic polypeptide
VDEYDPTIEDSYRKQVVIDGETCLLDILDTASQEEYSAMR

SEQ ID NO: 3150 - protein, 40 aa, Artificial Sequence
  Description of Artificial Sequence: Synthetic polypeptide
EAIICKNIPRLVSGWVKPIIIGCHAYGDQYRATDFVVPGP

SEQ ID NO: 3151 - protein, 40 aa, Artificial Sequence
  Description of Artificial Sequence: Synthetic polypeptide
RLVSGWVKPIIIGCHAYGDQYRATDFVVPGPGKVEITYTP

SEQ ID NO: 3152 - protein, 40 aa, Artificial Sequence
  Description of Artificial Sequence: Synthetic polypeptide
VKPIIIGHHAYGDQYRATDFVVPGPGKVEITYTPSDGTQK

SEQ ID NO: 3153 - protein, 40 aa, Artificial Sequence
  Description of Artificial Sequence: Synthetic polypeptide
VGRLIYTAGDYFRQSLSYLEAYNPSDGTWLRLADLQVPRS

SEQ ID NO: 3154 - protein, 40 aa, Artificial Sequence
  Description of Artificial Sequence: Synthetic polypeptide
DEWHLVAPMLTRRIGVGVAVLNRLLYAVGSFDGTNRLNSA

SEQ ID NO: 3155 - protein, 40 aa, Artificial Sequence
  Description of Artificial Sequence: Synthetic polypeptide
HLVAPMLTRRIGVGVAVLNRLLYAVGSFDGTNRLNSAECY

SEQ ID NO: 3156 - protein, 40 aa, Artificial Sequence
  Description of Artificial Sequence: Synthetic polypeptide
TRRIGVGVAVLNRLLYAVGSFDGTNRLNSAECYYPERNEW

SEQ ID NO: 3157 - protein, 40 aa, Artificial Sequence
  Description of Artificial Sequence: Synthetic polypeptide
LFTPLLIGFVIVAGMMCIIVMILTYKYLQKPMYEVQWKGV

SEQ ID NO: 3158 - protein, 40 aa, Artificial Sequence
  Description of Artificial Sequence: Synthetic polypeptide
YEVQWKGVEEINGNNYVYIDPTQLPYDHKWEFPRNRLSFG

SEQ ID NO: 3159 - protein, 40 aa, Artificial Sequence
  Description of Artificial Sequence: Synthetic polypeptide
VQWKGVEEINGNNYVYIDPTQLPYDHKWEFPRNRLSFGKT

SEQ ID NO: 3160 - protein, 40 aa, Artificial Sequence
  Description of Artificial Sequence: Synthetic polypeptide
QWKGVEEINGNNYVYIDPTQLPYDHKWEFPRNRLSFGKTL

SEQ ID NO: 3161 - protein, 40 aa, Artificial Sequence
  Description of Artificial Sequence: Synthetic polypeptide
GVEEINGNNYVYIDPTQLPYDHKWEFPRNRLSFGKTLGAG

SEQ ID NO: 3162 - protein, 40 aa, Artificial Sequence
  Description of Artificial Sequence: Synthetic polypeptide
PMYEVQWKVVEEINGNNYVYIDQTQLPYDHKWEFPRNRLS

SEQ ID NO: 3163 - protein, 40 aa, Artificial Sequence
  Description of Artificial Sequence: Synthetic polypeptide
MYEVQWKVVEEINGNNYVYIDQTQLPYDHKWEFPRNRLSF

SEQ ID NO: 3164 - protein, 40 aa, Artificial Sequence
  Description of Artificial Sequence: Synthetic polypeptide
YEVQWKVVEEINGNNYVYIDQTQLPYDHKWEFPRNRLSFG

SEQ ID NO: 3165 - protein, 40 aa, Artificial Sequence
  Description of Artificial Sequence: Synthetic polypeptide
EVQWKVVEEINGNNYVYIDQTQLPYDHKWEFPRNRLSFGK

SEQ ID NO: 3166 - protein, 40 aa, Artificial Sequence
  Description of Artificial Sequence: Synthetic polypeptide
VQWKVVEEINGNNYVYIDQTQLPYDHKWEFPRNRLSFGKT

SEQ ID NO: 3167 - protein, 40 aa, Artificial Sequence
  Description of Artificial Sequence: Synthetic polypeptide
VEEINGNNYVYIDQTQLPYDHKWEFPRNRLSFGKTLGAGA

SEQ ID NO: 3168 - protein, 40 aa, Artificial Sequence
  Description of Artificial Sequence: Synthetic polypeptide
EINGNNYVYIDQTQLPYDHKWEFPRNRLSFGKTLGAGAFG

SEQ ID NO: 3169 - protein, 40 aa, Artificial Sequence
  Description of Artificial Sequence: Synthetic polypeptide
GNNYVYIDQTQLPYDHKWEFPRNRLSFGKTLGAGAFGKVV

SEQ ID NO: 3170 - protein, 40 aa, Artificial Sequence
  Description of Artificial Sequence: Synthetic polypeptide
NNYVYIDQTQLPYDHKWEFPRNRLSFGKTLGAGAFGKVVE

SEQ ID NO: 3171 - protein, 40 aa, Artificial Sequence
  Description of Artificial Sequence: Synthetic polypeptide
QKPMYEVQWKVVEEINGNNYVYIDPTQPPYDHKWEFPRNR

SEQ ID NO: 3172 - protein, 40 aa, Artificial Sequence
  Description of Artificial Sequence: Synthetic polypeptide
QWKVVEEINGNNYVYIDPTQPPYDHKWEFPRNRLSFGKTL

SEQ ID NO: 3173 - protein, 40 aa, Artificial Sequence
  Description of Artificial Sequence: Synthetic polypeptide
WKVVEEINGNNYVYIDPTQPPYDHKWEFPRNRLSFGKTLG

SEQ ID NO: 3174 - protein, 40 aa, Artificial Sequence
  Description of Artificial Sequence: Synthetic polypeptide
VEEINGNNYVYIDPTQPPYDHKWEFPRNRLSFGKTLGAGA

SEQ ID NO: 3175 - protein, 40 aa, Artificial Sequence
  Description of Artificial Sequence: Synthetic polypeptide
EINGNNYVYIDPTQPPYDHKWEFPRNRLSFGKTLGAGAFG

SEQ ID NO: 3176 - protein, 40 aa, Artificial Sequence
  Description of Artificial Sequence: Synthetic polypeptide
NGNNYVYIDPTQPPYDHKWEFPRNRLSFGKTLGAGAFGKV

SEQ ID NO: 3177 - protein, 40 aa, Artificial Sequence
  Description of Artificial Sequence: Synthetic polypeptide
GNNYVYIDPTQPPYDHKWEFPRNRLSFGKTLGAGAFGKVV

SEQ ID NO: 3178 - protein, 40 aa, Artificial Sequence
  Description of Artificial Sequence: Synthetic polypeptide
NNYVYIDPTQPPYDHKWEFPRNRLSFGKTLGAGAFGKVVE

SEQ ID NO: 3179 - protein, 40 aa, Artificial Sequence
  Description of Artificial Sequence: Synthetic polypeptide
LTEREAHMSELKVLSYLGNHMNIVNLLGACTIGGPTLVIT

SEQ ID NO: 3180 - protein, 40 aa, Artificial Sequence
  Description of Artificial Sequence: Synthetic polypeptide
TEREALMSELEVLSYLGNHMNIVNLLGACTIGGPTLVITE

SEQ ID NO: 3181 - protein, 40 aa, Artificial Sequence
  Description of Artificial Sequence: Synthetic polypeptide
DLAARNILLTHGRITKICDFVLARDIKNDSNYVVKGNARL

SEQ ID NO: 3182 - protein, 40 aa, Artificial Sequence
  Description of Artificial Sequence: Synthetic polypeptide
KICDFVLARDIKNDSNYVVKGNARLPVKWMAPESIFNCVY

SEQ ID NO: 3183 - protein, 40 aa, Artificial Sequence
  Description of Artificial Sequence: Synthetic polypeptide
RDLAARNILLTHGRITKICDFGLARVIKNDSNYVVKGNAR

SEQ ID NO: 3184 - protein, 40 aa, Artificial Sequence
  Description of Artificial Sequence: Synthetic polypeptide
KICDFGLARYIKNDSNYVVKGNARLPVKWMAPESIFNCVY

SEQ ID NO: 3185 - protein, 40 aa, Artificial Sequence
  Description of Artificial Sequence: Synthetic polypeptide
DQFFCTTCGQHYHGMYLDIAVTPLKRAGWQCPECKVCQNC

SEQ ID NO: 3186 - protein, 40 aa, Artificial Sequence
  Description of Artificial Sequence: Synthetic polypeptide
EYKLVVVGARGVGKSALTIQLIQNHFVDEYDPTIEDSYRK

SEQ ID NO: 3187 - protein, 40 aa, Artificial Sequence
  Description of Artificial Sequence: Synthetic polypeptide
SALTIQLIQNHFVDEYDLTIEDSYRKQVVIDGETCLLDIL

SEQ ID NO: 3188 - protein, 40 aa, Artificial Sequence
  Description of Artificial Sequence: Synthetic polypeptide
IQLIQNHFVDEYDLTIEDSYRKQVVIDGETCLLDILDTAG

SEQ ID NO: 3189 - protein, 40 aa, Artificial Sequence
  Description of Artificial Sequence: Synthetic polypeptide
DGETCLLDILDTGGQEEYSAMRDQYMRTGEGFLCVFAINN

SEQ ID NO: 3190 - protein, 40 aa, Artificial Sequence
  Description of Artificial Sequence: Synthetic polypeptide
IEDSYRKQVVIDGETCLLDILDTTGQEEYSAMRDQYMRTG

SEQ ID NO: 3191 - protein, 40 aa, Artificial Sequence
  Description of Artificial Sequence: Synthetic polypeptide
QVVIDGETCLLDILDTTGQEEYSAMRDQYMRTGEGFLCVF

SEQ ID NO: 3192 - protein, 40 aa, Artificial Sequence
  Description of Artificial Sequence: Synthetic polypeptide
HFVDEYDPTIEDSYRKQVVIDGETCLLDILDTAGKEEYSA

SEQ ID NO: 3193 - protein, 40 aa, Artificial Sequence
  Description of Artificial Sequence: Synthetic polypeptide
EYDPTIEDSYRKQVVIDGETCLLDILDTAGKEEYSAMRDQ

SEQ ID NO: 3194 - protein, 40 aa, Artificial Sequence
  Description of Artificial Sequence: Synthetic polypeptide
QNHFVDEYDPTIEDSYRKQVVIDGETCLLDILDTAGREEY

SEQ ID NO: 3195 - protein, 40 aa, Artificial Sequence
  Description of Artificial Sequence: Synthetic polypeptide
FVDEYDPTIEDSYRKQVVIDGETCLLDILDTAGREEYSAM

SEQ ID NO: 3196 - protein, 40 aa, Artificial Sequence
  Description of Artificial Sequence: Synthetic polypeptide
RKQVVIDGETCLLDILDTAGQKEYSAMRDQYMRTGEGFLC

SEQ ID NO: 3197 - protein, 40 aa, Artificial Sequence
  Description of Artificial Sequence: Synthetic polypeptide
KQVVIDGETCLLDILDTAGQKEYSAMRDQYMRTGEGFLCV

SEQ ID NO: 3198 - protein, 40 aa, Artificial Sequence
  Description of Artificial Sequence: Synthetic polypeptide
QVVIDGETCLLDILDTAGQEKYSAMRDQYMRTGEGFLCVF

SEQ ID NO: 3199 - protein, 40 aa, Artificial Sequence
  Description of Artificial Sequence: Synthetic polypeptide
MARKLIHLEIKPAIRNQIIRELQVLHERNSPYIVGFYGAF

SEQ ID NO: 3200 - protein, 40 aa, Artificial Sequence
  Description of Artificial Sequence: Synthetic polypeptide
ARKLIHLEIKPAIRNQIIRELQVLHECNSLYIVGFYGAFY

SEQ ID NO: 3201 - protein, 40 aa, Artificial Sequence
  Description of Artificial Sequence: Synthetic polypeptide
RELQVLHECNSLYIVGFYGAFYSDGEISICMEHMDGGSLD

SEQ ID NO: 3202 - protein, 40 aa, Artificial Sequence
  Description of Artificial Sequence: Synthetic polypeptide
CGAFYSDGEISICMEHMDGGSLDQVLKKAGRIPEQILGKV

SEQ ID NO: 3203 - protein, 40 aa, Artificial Sequence
  Description of Artificial Sequence: Synthetic polypeptide
GRGHFGCVYHGTLLDNDGKKIHCAVISLNRITDIGEVSQF

SEQ ID NO: 3204 - protein, 40 aa, Artificial Sequence
  Description of Artificial Sequence: Synthetic polypeptide
EKFTVKVADFGLARDMYDKEYYSVHNKTGAKLHVKWMALE

SEQ ID NO: 3205 - protein, 40 aa, Artificial Sequence
  Description of Artificial Sequence: Synthetic polypeptide
KFTVKVADFGLARDMYDKEYYSVHNKTGAKLHVKWMALES

SEQ ID NO: 3206 - protein, 40 aa, Artificial Sequence
  Description of Artificial Sequence: Synthetic polypeptide
VKVADFGLARDMYDKEYYSVHNKTGAKLHVKWMALESLQT

SEQ ID NO: 3207 - protein, 40 aa, Artificial Sequence
  Description of Artificial Sequence: Synthetic polypeptide
KVADFGLARDMYDKEYYSVHNKTGAKLHVKWMALESLQTQ

SEQ ID NO: 3208 - protein, 40 aa, Artificial Sequence
  Description of Artificial Sequence: Synthetic polypeptide
FGLARDMYDKEYYSVHNKTGAKLHVKWMALESLQTQKFTT

SEQ ID NO: 3209 - protein, 40 aa, Artificial Sequence
  Description of Artificial Sequence: Synthetic polypeptide
DEKFTVKVADFGLARDMYDKEYYSVHNKTGAKLPVCWMAL

SEQ ID NO: 3210 - protein, 40 aa, Artificial Sequence
  Description of Artificial Sequence: Synthetic polypeptide
KVADFGLARDMYDKEYYSVHNKTGAKLPVCWMALESLQTQ

SEQ ID NO: 3211 - protein, 40 aa, Artificial Sequence
  Description of Artificial Sequence: Synthetic polypeptide
DMYDKEYYSVHNKTGAKLPVCWMALESLQTQKFTTKSDVW

SEQ ID NO: 3212 - protein, 40 aa, Artificial Sequence
  Description of Artificial Sequence: Synthetic polypeptide
KEYYSVHNKTGAKLPVCWMALESLQTQKFTTKSDVWSFGV

SEQ ID NO: 3213 - protein, 40 aa, Artificial Sequence
  Description of Artificial Sequence: Synthetic polypeptide
LDEKFTVKVADFGLARDMYDKEYYSVHNKTGAKLPVHWMA

SEQ ID NO: 3214 - protein, 40 aa, Artificial Sequence
  Description of Artificial Sequence: Synthetic polypeptide
EKFTVKVADFGLARDMYDKEYYSVHNKTGAKLPVHWMALE

SEQ ID NO: 3215 - protein, 40 aa, Artificial Sequence
  Description of Artificial Sequence: Synthetic polypeptide
FGLARDMYDKEYYSVHNKTGAKLPVHWMALESLQTQKFTT

SEQ ID NO: 3216 - protein, 40 aa, Artificial Sequence
  Description of Artificial Sequence: Synthetic polypeptide
HWMALESLQTQKFTTKSDVWSFGVLLWELMTRGAPPYPDV

SEQ ID NO: 3217 - protein, 40 aa, Artificial Sequence
  Description of Artificial Sequence: Synthetic polypeptide
QKKLEKERQEQLQKEQEKAFFAQLQLGEETGEFLPIQPAQ

SEQ ID NO: 3218 - protein, 40 aa, Artificial Sequence
  Description of Artificial Sequence: Synthetic polypeptide
EKERQEQLQKEQEKAFFAQLQLDEEAGEFLPIQPAQHIQS

SEQ ID NO: 3219 - protein, 40 aa, Artificial Sequence
  Description of Artificial Sequence: Synthetic polypeptide
LEKERQEQLQKEQEKAFFAQLQLDEETVEFLPIQPAQHIQ

SEQ ID NO: 3220 - protein, 40 aa, Artificial Sequence
  Description of Artificial Sequence: Synthetic polypeptide
KLEKERQEQLQKEQEKAFFAQLQLDEETGDFLPIQPAQHI

SEQ ID NO: 3221 - protein, 40 aa, Artificial Sequence
  Description of Artificial Sequence: Synthetic polypeptide
KLEKERQEQLQKEQEKAFFAQLQLDEETGVFLPIQPAQHI

SEQ ID NO: 3222 - protein, 40 aa, Artificial Sequence
  Description of Artificial Sequence: Synthetic polypeptide
KLVVVGADGVGKSALTIQLIQNHFVDEYDPTIEDSYRKQV

SEQ ID NO: 3223 - protein, 40 aa, Artificial Sequence
  Description of Artificial Sequence: Synthetic polypeptide
TAGHEEYSAMRDQYMRTGEGFLCVFAINNSKSFADINLYR

SEQ ID NO: 3224 - protein, 40 aa, Artificial Sequence
  Description of Artificial Sequence: Synthetic polypeptide
PTIEDSYRKQVVIDGETCLLDILDTAGKEEYSAMRDQYMR

SEQ ID NO: 3225 - protein, 40 aa, Artificial Sequence
  Description of Artificial Sequence: Synthetic polypeptide
TAGKEEYSAMRDQYMRTGEGFLCVFAINNSKSFADINLYR

SEQ ID NO: 3226 - protein, 40 aa, Artificial Sequence
  Description of Artificial Sequence: Synthetic polypeptide
SALRIKILCATYMNVNIRDIDKIYVRTGIYHGGEPLCDNV

SEQ ID NO: 3227 - protein, 40 aa, Artificial Sequence
  Description of Artificial Sequence: Synthetic polypeptide
NSALRIKILCATYVIVNIRDIDKIYVRTGIYHGGEPLCDN

SEQ ID NO: 3228 - protein, 40 aa, Artificial Sequence
  Description of Artificial Sequence: Synthetic polypeptide
VIVNIRDIDKIYVRTGIYHGGEPLCDNVNTQRVPCSNPRW

SEQ ID NO: 3229 - protein, 40 aa, Artificial Sequence
  Description of Artificial Sequence: Synthetic polypeptide
KSLWVINSALRIKILCATYVYVNIRDIDKIYVRTGIYHGG

SEQ ID NO: 3230 - protein, 40 aa, Artificial Sequence
  Description of Artificial Sequence: Synthetic polypeptide
SLWVINSALRIKILCATYVYVNIRDIDKIYVRTGIYHGGE

SEQ ID NO: 3231 - protein, 40 aa, Artificial Sequence
  Description of Artificial Sequence: Synthetic polypeptide
NSALRIKILCATYVYVNIRDIDKIYVRTGIYHGGEPLCDN

SEQ ID NO: 3232 - protein, 40 aa, Artificial Sequence
  Description of Artificial Sequence: Synthetic polypeptide
ILCATYVYVNIRDIDKIYVRTGIYHGGEPLCDNVNTQRVP

SEQ ID NO: 3233 - protein, 40 aa, Artificial Sequence
  Description of Artificial Sequence: Synthetic polypeptide
LWVINSALRIKILCATYVNVNIRDIDKIYVRTGIYHGGVP

SEQ ID NO: 3234 - protein, 40 aa, Artificial Sequence
  Description of Artificial Sequence: Synthetic polypeptide
INSALRIKILCATYVNVNIRDIDKIYVRTGIYHGGVPLCD

SEQ ID NO: 3235 - protein, 40 aa, Artificial Sequence
  Description of Artificial Sequence: Synthetic polypeptide
NSALRIKILCATYVNVNIRDIDKIYVRTGIYHGGVPLCDN

SEQ ID NO: 3236 - protein, 40 aa, Artificial Sequence
  Description of Artificial Sequence: Synthetic polypeptide
LRIKILCATYVNVNIRDIDKIYVRTGIYHGGVPLCDNVNT

SEQ ID NO: 3237 - protein, 40 aa, Artificial Sequence
  Description of Artificial Sequence: Synthetic polypeptide
VNVNIRDIDKIYVRTGIYHGGVPLCDNVNTQRVPCSNPRW

SEQ ID NO: 3238 - protein, 40 aa, Artificial Sequence
  Description of Artificial Sequence: Synthetic polypeptide
RWNEWLNYDIYIPDLPRAARLCLSICSVKGRKGAKEEHRP

SEQ ID NO: 3239 - protein, 40 aa, Artificial Sequence
  Description of Artificial Sequence: Synthetic polypeptide
NYDIYIPDLPRAARLCLSICSVKGRKGAKEEHRPLAWGNI

SEQ ID NO: 3240 - protein, 40 aa, Artificial Sequence
  Description of Artificial Sequence: Synthetic polypeptide
KGRKGAKEEHRPLAWGNINLFDYTDTLVSGKMALNLWPVP

SEQ ID NO: 3241 - protein, 40 aa, Artificial Sequence
  Description of Artificial Sequence: Synthetic polypeptide
RPLAWGNINLFDYTDTLVSGKMALNLWPVPHGLEDLLNPI

SEQ ID NO: 3242 - protein, 40 aa, Artificial Sequence
  Description of Artificial Sequence: Synthetic polypeptide
EDLLNPIGVTGSNPNKETLCLELEFDWFSSVVKFPDMSVI

SEQ ID NO: 3243 - protein, 40 aa, Artificial Sequence
  Description of Artificial Sequence: Synthetic polypeptide
PIGVTGSNPNKETLCLELEFDWFSSVVKFPDMSVIEEHAN

SEQ ID NO: 3244 - protein, 40 aa, Artificial Sequence
  Description of Artificial Sequence: Synthetic polypeptide
GLSNRLARDNELRENDKEQLKAISTRDRLSEITEQEKDFL

SEQ ID NO: 3245 - protein, 40 aa, Artificial Sequence
  Description of Artificial Sequence: Synthetic polypeptide
RDNELRENDKEQLKAISTRDRLSEITEQEKDFLWSHRHYC

SEQ ID NO: 3246 - protein, 40 aa, Artificial Sequence
  Description of Artificial Sequence: Synthetic polypeptide
DRLSEITEQEKDFLWSHRHYCVTIPEILPKLLLSVKWNSR

SEQ ID NO: 3247 - protein, 40 aa, Artificial Sequence
  Description of Artificial Sequence: Synthetic polypeptide
PLSEITAQEKDFLWSHRHYCVTIPEILPKLLLSVKWNSRD

SEQ ID NO: 3248 - protein, 40 aa, Artificial Sequence
  Description of Artificial Sequence: Synthetic polypeptide
TAQEKDFLWSHRHYCVTIPEILPKLLLSVKWNSRDEVAQM

SEQ ID NO: 3249 - protein, 40 aa, Artificial Sequence
  Description of Artificial Sequence: Synthetic polypeptide
DPLSEITKQEKDFLWSHRHYCVTIPEILPKLLLSVKWNSR

SEQ ID NO: 3250 - protein, 40 aa, Artificial Sequence
  Description of Artificial Sequence: Synthetic polypeptide
TKQEKDFLWSHRHYCVTIPEILPKLLLSVKWNSRDEVAQM

SEQ ID NO: 3251 - protein, 40 aa, Artificial Sequence
  Description of Artificial Sequence: Synthetic polypeptide
KQEKDFLWSHRHYCVTIPEILPKLLLSVKWNSRDEVAQMY

SEQ ID NO: 3252 - protein, 40 aa, Artificial Sequence
  Description of Artificial Sequence: Synthetic polypeptide
DPLSEITEREKDFLWSHRHYCVTIPEILPKLLLSVKWNSR

SEQ ID NO: 3253 - protein, 40 aa, Artificial Sequence
  Description of Artificial Sequence: Synthetic polypeptide
PLSEITEREKDFLWSHRHYCVTIPEILPKLLLSVKWNSRD

SEQ ID NO: 3254 - protein, 40 aa, Artificial Sequence
  Description of Artificial Sequence: Synthetic polypeptide
FTQDFLIVISKGAQECTKTREFERFQEMCYKAYLAIRQHA

SEQ ID NO: 3255 - protein, 40 aa, Artificial Sequence
  Description of Artificial Sequence: Synthetic polypeptide
ISREEVNEKLRDTADGTFLVRDASTKMHGDYTLTLRKWGN

SEQ ID NO: 3256 - protein, 40 aa, Artificial Sequence
  Description of Artificial Sequence: Synthetic polypeptide
SREEVNEKLRDTADGTFLVRDASTKMHGDYTLTLRKWGNN

SEQ ID NO: 3257 - protein, 40 aa, Artificial Sequence
  Description of Artificial Sequence: Synthetic polypeptide
RDTADGTFLVRDASTKMHGDYTLTLRKGRNNKLIKIFHRD

SEQ ID NO: 3258 - protein, 40 aa, Artificial Sequence
  Description of Artificial Sequence: Synthetic polypeptide
DASTKMHGDYTLTLRKGRNNKLIKIFHRDGKYGFSDPLTF

SEQ ID NO: 3259 - protein, 40 aa, Artificial Sequence
  Description of Artificial Sequence: Synthetic polypeptide
TKMHGDYTLTLRKGRNNKLIKIFHRDGKYGFSDPLTFSSV

SEQ ID NO: 3260 - protein, 40 aa, Artificial Sequence
  Description of Artificial Sequence: Synthetic polypeptide
MHGDYTLTLRKGRNNKLIKIFHRDGKYGFSDPLTFSSVVE

SEQ ID NO: 3261 - protein, 40 aa, Artificial Sequence
  Description of Artificial Sequence: Synthetic polypeptide
LRKGRNNKLIKIFHRDGKYGFSDPLTFSSVVELINHYRNE

SEQ ID NO: 3262 - protein, 40 aa, Artificial Sequence
  Description of Artificial Sequence: Synthetic polypeptide
LRDTADGTFLVRDASTKMHGDYTLTLRKGGNNELIKIFHR

SEQ ID NO: 3263 - protein, 40 aa, Artificial Sequence
  Description of Artificial Sequence: Synthetic polypeptide
TKMHGDYTLTLRKGGNNELIKIFHRDGKYGFSDPLTFSSV

SEQ ID NO: 3264 - protein, 40 aa, Artificial Sequence
  Description of Artificial Sequence: Synthetic polypeptide
MHGDYTLTLRKGGNNELIKIFHRDGKYGFSDPLTFSSVVE

SEQ ID NO: 3265 - protein, 40 aa, Artificial Sequence
  Description of Artificial Sequence: Synthetic polypeptide
HGDYTLTLRKGGNNELIKIFHRDGKYGFSDPLTFSSVVEL

SEQ ID NO: 3266 - protein, 40 aa, Artificial Sequence
  Description of Artificial Sequence: Synthetic polypeptide
LTLRKGGNNELIKIFHRDGKYGFSDPLTFSSVVELINHYR

SEQ ID NO: 3267 - protein, 40 aa, Artificial Sequence
  Description of Artificial Sequence: Synthetic polypeptide
LRKGGNNELIKIFHRDGKYGFSDPLTFSSVVELINHYRNE

SEQ ID NO: 3268 - protein, 40 aa, Artificial Sequence
  Description of Artificial Sequence: Synthetic polypeptide
MHGDYTLTLRKGGNNNLIKIFHRDGKYGFSDPLTFSSVVE

SEQ ID NO: 3269 - protein, 40 aa, Artificial Sequence
  Description of Artificial Sequence: Synthetic polypeptide
KLKSRISEIIDSRRRLEEDLKKQAAEYPEIDKRMNSIKPD

SEQ ID NO: 3270 - protein, 40 aa, Artificial Sequence
  Description of Artificial Sequence: Synthetic polypeptide
RISEIIDSRRRLEEDLKKQAAEYPEIDKRMNSIKPDLIQL

SEQ ID NO: 3271 - protein, 40 aa, Artificial Sequence
  Description of Artificial Sequence: Synthetic polypeptide
ISEIIDSRRRLEEDLKKQAAEYPEIDKRMNSIKPDLIQLR

SEQ ID NO: 3272 - protein, 40 aa, Artificial Sequence
  Description of Artificial Sequence: Synthetic polypeptide
DSRRRLEEDLKKQAAEYPEIDKRMNSIKPDLIQLRKTRDQ

SEQ ID NO: 3273 - protein, 40 aa, Artificial Sequence
  Description of Artificial Sequence: Synthetic polypeptide
RRLEEDLKKQAAEYPEIDKRMNSIKPDLIQLRKTRDQYLM

SEQ ID NO: 3274 - protein, 40 aa, Artificial Sequence
  Description of Artificial Sequence: Synthetic polypeptide
IQRIMHNYDKLKSRISEIIDSRRRLEEDLKKQAAEYREIG

SEQ ID NO: 3275 - protein, 40 aa, Artificial Sequence
  Description of Artificial Sequence: Synthetic polypeptide
EYREIYKRMNSIKPDLIQLRKTRDQYLMWLTQKGVRQKKL

SEQ ID NO: 3276 - protein, 40 aa, Artificial Sequence
  Description of Artificial Sequence: Synthetic polypeptide
EEDLKKQAAEYREIDKRMNRIKPDLIQLRKTRDQYLMWLT

SEQ ID NO: 3277 - protein, 40 aa, Artificial Sequence
  Description of Artificial Sequence: Synthetic polypeptide
RLEEDLKKQAAEYREIDKRMNSIEPDLIQLRKTRDQYLMW

SEQ ID NO: 3278 - protein, 40 aa, Artificial Sequence
  Description of Artificial Sequence: Synthetic polypeptide
IDSRRRLEEDLKKQAAEYREIDKRMNSIKTDLIQLRKTRD

SEQ ID NO: 3279 - protein, 40 aa, Artificial Sequence
  Description of Artificial Sequence: Synthetic polypeptide
EDLKKQAAEYREIDKRMNSIKTDLIQLRKTRDQYLMWLTQ

SEQ ID NO: 3280 - protein, 40 aa, Artificial Sequence
  Description of Artificial Sequence: Synthetic polypeptide
RAISHEHSPSDLEAHFVPLVKRLAGGDWFTSCTSACGLFS

SEQ ID NO: 3281 - protein, 40 aa, Artificial Sequence
  Description of Artificial Sequence: Synthetic polypeptide
AISHEHSPSDLEAHFVPLVKRLAGGDWFTSCTSACGLFSV

SEQ ID NO: 3282 - protein, 40 aa, Artificial Sequence
  Description of Artificial Sequence: Synthetic polypeptide
ISHEHSPSDLEAHFVPLVKRLAGGDWFTSCTSACGLFSVC

SEQ ID NO: 3283 - protein, 40 aa, Artificial Sequence
  Description of Artificial Sequence: Synthetic polypeptide
SPSDLEAHFVPLVKRLAGGDWFTSCTSACGLFSVCYPRVS

SEQ ID NO: 3284 - protein, 40 aa, Artificial Sequence
  Description of Artificial Sequence: Synthetic polypeptide
PSDLEAHFVPLVKRLAGGDWFTSCTSACGLFSVCYPRVSS

SEQ ID NO: 3285 - protein, 40 aa, Artificial Sequence
  Description of Artificial Sequence: Synthetic polypeptide
FVPLVKRLAGGDWFTSCTSACGLFSVCYPRVSSAVKAELR

SEQ ID NO: 3286 - protein, 40 aa, Artificial Sequence
  Description of Artificial Sequence: Synthetic polypeptide
AGGDWFTSCTSACGLFSVCYPRVSSAVKAELRQYFRNLCS

SEQ ID NO: 3287 - protein, 40 aa, Artificial Sequence
  Description of Artificial Sequence: Synthetic polypeptide
ELRQYFRNLCSDDTPMVRQAAASKLGEFAKVLELDNVKSE

SEQ ID NO: 3288 - protein, 40 aa, Artificial Sequence
  Description of Artificial Sequence: Synthetic polypeptide
QQECKLLYSRKEGQRQENKNKNRCKNILPFDHTRVVLHDG

SEQ ID NO: 3289 - protein, 40 aa, Artificial Sequence
  Description of Artificial Sequence: Synthetic polypeptide
YSRKEGQRQENKNKNRCKNILPFDHTRVVLHDGDPNEPVS

SEQ ID NO: 3290 - protein, 40 aa, Artificial Sequence
  Description of Artificial Sequence: Synthetic polypeptide
SRKEGQRQENKNKNRCKNILPFDHTRVVLHDGDPNEPVSD

SEQ ID NO: 3291 - protein, 40 aa, Artificial Sequence
  Description of Artificial Sequence: Synthetic polypeptide
ENKNKNRCKNILPFDHTRVVLHDGDPNEPVSDYINANIIM

SEQ ID NO: 3292 - protein, 40 aa, Artificial Sequence
  Description of Artificial Sequence: Synthetic polypeptide
GRTGTFIVIDILIDIIREKGVDCDIDVPKTIQMVWSQRSG

SEQ ID NO: 3293 - protein, 40 aa, Artificial Sequence
  Description of Artificial Sequence: Synthetic polypeptide
GTFIVIDILIDIIREKGVDCDIDVPKTIQMVWSQRSGMVQ

SEQ ID NO: 3294 - protein, 40 aa, Artificial Sequence
  Description of Artificial Sequence: Synthetic polypeptide
RTGTFIVIDILIDIIREKGVDCDIDVPKTIQMVRSQRSVM

SEQ ID NO: 3295 - protein, 40 aa, Artificial Sequence
  Description of Artificial Sequence: Synthetic polypeptide
RSQRSGMVQKEAQYRFIYMAVQHYIETLQRRIEEEQKSKR

SEQ ID NO: 3296 - protein, 40 aa, Artificial Sequence
  Description of Artificial Sequence: Synthetic polypeptide
RPSKSNPGDFTLSVRRNGAVTHIKIQNTVDYYDLYGGEKF

SEQ ID NO: 3297 - protein, 40 aa, Artificial Sequence
  Description of Artificial Sequence: Synthetic polypeptide
PSKSNPGDFTLSVRRNGAVTHIKIQNTVDYYDLYGGEKFA

SEQ ID NO: 3298 - protein, 40 aa, Artificial Sequence
  Description of Artificial Sequence: Synthetic polypeptide
KSNPGDFTLSVRRNGAVTHIKIQNTGDYYDLYGGEKLATL

SEQ ID NO: 3299 - protein, 40 aa, Artificial Sequence
  Description of Artificial Sequence: Synthetic polypeptide
KSNPGDFTLSVRRNGAVTHIKIQNTGDYYDLYGGEKFDTL

SEQ ID NO: 3300 - protein, 40 aa, Artificial Sequence
  Description of Artificial Sequence: Synthetic polypeptide
DFTLSVRRNGAVTHIKIQNTGDYYDLYGGEKFATLAALVQ

SEQ ID NO: 3301 - protein, 40 aa, Artificial Sequence
  Description of Artificial Sequence: Synthetic polypeptide
GDFTLSVRRNGAVTHIKIQNTGDYYDLYGGEKFATLAKLV

SEQ ID NO: 3302 - protein, 40 aa, Artificial Sequence
  Description of Artificial Sequence: Synthetic polypeptide
KCVVVGDGAVSKTCLLISYTTNAFPGEYIPTVFDNYSANV

SEQ ID NO: 3303 - protein, 40 aa, Artificial Sequence
  Description of Artificial Sequence: Synthetic polypeptide
DGAVSKTCLLISYTTNAFPGEYIPTVFDNYSANVMVDGKP

SEQ ID NO: 3304 - protein, 40 aa, Artificial Sequence
  Description of Artificial Sequence: Synthetic polypeptide
VSKTCLLISYTTNAFPGEYIPTVFDNYSANVMVDGKPVNL

SEQ ID NO: 3305 - protein, 40 aa, Artificial Sequence
  Description of Artificial Sequence: Synthetic polypeptide
KTYLLISYTTNAFPGEYIPTVFDNYSANVMVDGKPVNLGL

SEQ ID NO: 3306 - protein, 40 aa, Artificial Sequence
  Description of Artificial Sequence: Synthetic polypeptide
VGKTCLLISYTTNAFSGEYIPTVFDNYSANVMVDGKPVNL

SEQ ID NO: 3307 - protein, 40 aa, Artificial Sequence
  Description of Artificial Sequence: Synthetic polypeptide
KTCLLISYTTNAFSGEYIPTVFDNYSANVMVDGKPVNLGL

SEQ ID NO: 3308 - protein, 40 aa, Artificial Sequence
  Description of Artificial Sequence: Synthetic polypeptide
VDGKPVNLGLWDTAGREDYDRLRPLSYPQTVGETYGKDIT

SEQ ID NO: 3309 - protein, 40 aa, Artificial Sequence
  Description of Artificial Sequence: Synthetic polypeptide
GKPVNLGLWDTAGREDYDRLRPLSYPQTVGETYGKDITSR

SEQ ID NO: 3310 - protein, 40 aa, Artificial Sequence
  Description of Artificial Sequence: Synthetic polypeptide
LWDTAGREDYDRLRPLSYPQTVGETYGKDITSRGKDKPIA

SEQ ID NO: 3311 - protein, 40 aa, Artificial Sequence
  Description of Artificial Sequence: Synthetic polypeptide
KPVNLGLWDTAGQEDYDRLHPLSYPQTVGETYGKDITSRG

SEQ ID NO: 3312 - protein, 40 aa, Artificial Sequence
  Description of Artificial Sequence: Synthetic polypeptide
DTAGQEDYDRLHPLSYPQTVGETYGKDITSRGKDKPIADV

SEQ ID NO: 3313 - protein, 40 aa, Artificial Sequence
  Description of Artificial Sequence: Synthetic polypeptide
RLHPLSYPQTVGETYGKDITSRGKDKPIADVFLICFSLVS

SEQ ID NO: 3314 - protein, 40 aa, Artificial Sequence
  Description of Artificial Sequence: Synthetic polypeptide
RIFLHEKLESLLLCTLNDREISMEDEATTLFLATTLASTL

SEQ ID NO: 3315 - protein, 40 aa, Artificial Sequence
  Description of Artificial Sequence: Synthetic polypeptide
EGNLTREMIKHLERCEHRIMESLASLSDSPLFDLIKQSKD

SEQ ID NO: 3316 - protein, 40 aa, Artificial Sequence
  Description of Artificial Sequence: Synthetic polypeptide
IKHLERCEHRIMESLASLSDSPLFDLIKQSKDREGPTDHL

SEQ ID NO: 3317 - protein, 40 aa, Artificial Sequence
  Description of Artificial Sequence: Synthetic polypeptide
RIMESLASLSDSPLFDLIKQSKDREGPTDHLESACPLNLP

SEQ ID NO: 3318 - protein, 40 aa, Artificial Sequence
  Description of Artificial Sequence: Synthetic polypeptide
ESLASLSDSPLFDLIKQSKDREGPTDHLESACPLNLPLQN

SEQ ID NO: 3319 - protein, 40 aa, Artificial Sequence
  Description of Artificial Sequence: Synthetic polypeptide
SLASLSDSPLFDLIKQSKDREGPTDHLESACPLNLPLQNN

SEQ ID NO: 3320 - protein, 40 aa, Artificial Sequence
  Description of Artificial Sequence: Synthetic polypeptide
LASLSDSPLFDLIKQSKDREGPTDHLESACPLNLPLQNNH

SEQ ID NO: 3321 - protein, 40 aa, Artificial Sequence
  Description of Artificial Sequence: Synthetic polypeptide
ASLSDSPLFDLIKQSKDREGPTDHLESACPLNLPLQNNHT

SEQ ID NO: 3322 - protein, 40 aa, Artificial Sequence
  Description of Artificial Sequence: Synthetic polypeptide
FVDSYDPTIENTFTKLITVNGQEYHLQLVVTAGQDEYSIF

SEQ ID NO: 3323 - protein, 40 aa, Artificial Sequence
  Description of Artificial Sequence: Synthetic polypeptide
PTIENTFTKLITVNGQEYHLQLVVTAGQDEYSIFPQTYSI

SEQ ID NO: 3324 - protein, 40 aa, Artificial Sequence
  Description of Artificial Sequence: Synthetic polypeptide
TFTKLITVNGQEYHLQLVVTAGQDEYSIFPQTYSIDINGY

SEQ ID NO: 3325 - protein, 40 aa, Artificial Sequence
  Description of Artificial Sequence: Synthetic polypeptide
TKLITVNGQEYHLQLVVTAGQDEYSIFPQTYSIDINGYIL

SEQ ID NO: 3326 - protein, 40 aa, Artificial Sequence
  Description of Artificial Sequence: Synthetic polypeptide
ITVNGQEYHLQLVVTAGQDEYSIFPQTYSIDINGYILVYS

SEQ ID NO: 3327 - protein, 40 aa, Artificial Sequence
  Description of Artificial Sequence: Synthetic polypeptide
TVNGQEYHLQLVVTAGQDEYSIFPQTYSIDINGYILVYSV

SEQ ID NO: 3328 - protein, 40 aa, Artificial Sequence
  Description of Artificial Sequence: Synthetic polypeptide
GQEYHLQLVVTAGQDEYSIFPQTYSIDINGYILVYSVTSI

SEQ ID NO: 3329 - protein, 40 aa, Artificial Sequence
  Description of Artificial Sequence: Synthetic polypeptide
HLQLVVTAGQDEYSIFPQTYSIDINGYILVYSVTSIKSFE

SEQ ID NO: 3330 - protein, 40 aa, Artificial Sequence
  Description of Artificial Sequence: Synthetic polypeptide
CAKTCLLIVFSKDQFPEVYVPTVFENYVADIEVDGKQVEL

SEQ ID NO: 3331 - protein, 40 aa, Artificial Sequence
  Description of Artificial Sequence: Synthetic polypeptide
ACGKTCLRIVFSKDQFPEVYVPTVFENYVADIEVDGKQVE

SEQ ID NO: 3332 - protein, 40 aa, Artificial Sequence
  Description of Artificial Sequence: Synthetic polypeptide
CLRIVFSKDQFPEVYVPTVFENYVADIEVDGKQVELALWD

SEQ ID NO: 3333 - protein, 40 aa, Artificial Sequence
  Description of Artificial Sequence: Synthetic polypeptide
CGKTCLLIVFSKDQFPEVYVPIVFENYVADIEVDGKQVEL

SEQ ID NO: 3334 - protein, 40 aa, Artificial Sequence
  Description of Artificial Sequence: Synthetic polypeptide
IVFSKDQFPEVYVPIVFENYVADIEVDGKQVELALWDTAG

SEQ ID NO: 3335 - protein, 40 aa, Artificial Sequence
  Description of Artificial Sequence: Synthetic polypeptide
TCLLIVFSKDQFPEVYVPTVFENCVADIEVDGKQVELALW

SEQ ID NO: 3336 - protein, 40 aa, Artificial Sequence
  Description of Artificial Sequence: Synthetic polypeptide
IVFSKDQFPEVYVPTVFENCVADIEVDGKQVELALWDTAG

SEQ ID NO: 3337 - protein, 40 aa, Artificial Sequence
  Description of Artificial Sequence: Synthetic polypeptide
FENCVADIEVDGKQVELALWDTAGQEDYDRLRPLSYPDTD

SEQ ID NO: 3338 - protein, 40 aa, Artificial Sequence
  Description of Artificial Sequence: Synthetic polypeptide
CLLIVFSKDQFPEVYVPTVFENYVADIKVDGKQVELALWD

SEQ ID NO: 3339 - protein, 40 aa, Artificial Sequence
  Description of Artificial Sequence: Synthetic polypeptide
VFENYVADIKVDGKQVELALWDTAGQEDYDRLRPLSYPDT

SEQ ID NO: 3340 - protein, 40 aa, Artificial Sequence
  Description of Artificial Sequence: Synthetic polypeptide
DIKVDGKQVELALWDTAGQEDYDRLRPLSYPDTDVILMCF

SEQ ID NO: 3341 - protein, 40 aa, Artificial Sequence
  Description of Artificial Sequence: Synthetic polypeptide
IKVDGKQVELALWDTAGQEDYDRLRPLSYPDTDVILMCFS

SEQ ID NO: 3342 - protein, 40 aa, Artificial Sequence
  Description of Artificial Sequence: Synthetic polypeptide
IVFSKDQFPEVYVPTVFENYVADIEVDGKQVELALWGTAG

SEQ ID NO: 3343 - protein, 40 aa, Artificial Sequence
  Description of Artificial Sequence: Synthetic polypeptide
NYVADIEVDGKQVELALWGTAGQEDYDRLRPLSYPDTDVI

SEQ ID NO: 3344 - protein, 40 aa, Artificial Sequence
  Description of Artificial Sequence: Synthetic polypeptide
DIEVDGKQVELALWGTAGQEDYDRLRPLSYPDTDVILMCF

SEQ ID NO: 3345 - protein, 40 aa, Artificial Sequence
  Description of Artificial Sequence: Synthetic polypeptide
IEVDGKQVELALWGTAGQEDYDRLRPLSYPDTDVILMCFS

SEQ ID NO: 3346 - protein, 40 aa, Artificial Sequence
  Description of Artificial Sequence: Synthetic polypeptide
VDGKQVELALWGTAGQEDYDRLRPLSYPDTDVILMCFSID

SEQ ID NO: 3347 - protein, 40 aa, Artificial Sequence
  Description of Artificial Sequence: Synthetic polypeptide
DGKQVELALWGTAGQEDYDRLRPLSYPDTDVILMCFSIDS

SEQ ID NO: 3348 - protein, 40 aa, Artificial Sequence
  Description of Artificial Sequence: Synthetic polypeptide
LALWGTAGQEDYDRLRPLSYPDTDVILMCFSIDSPDSLEN

SEQ ID NO: 3349 - protein, 40 aa, Artificial Sequence
  Description of Artificial Sequence: Synthetic polypeptide
CLLIVFSKDQFPEVYVPTVFENYVADIEVDGKQVELALWY

SEQ ID NO: 3350 - protein, 40 aa, Artificial Sequence
  Description of Artificial Sequence: Synthetic polypeptide
YVPTVFENYVADIEVDGKQVELALWYTAGQEDYDRLRPLS

SEQ ID NO: 3351 - protein, 40 aa, Artificial Sequence
  Description of Artificial Sequence: Synthetic polypeptide
NYVADIEVDGKQVELALWYTAGQEDYDRLRPLSYPDTDVI

SEQ ID NO: 3352 - protein, 40 aa, Artificial Sequence
  Description of Artificial Sequence: Synthetic polypeptide
IEVDGKQVELALWYTAGQEDYDRLRPLSYPDTDVILMCFS

SEQ ID NO: 3353 - protein, 40 aa, Artificial Sequence
  Description of Artificial Sequence: Synthetic polypeptide
DGKQVELALWYTAGQEDYDRLRPLSYPDTDVILMCFSIDS

SEQ ID NO: 3354 - protein, 40 aa, Artificial Sequence
  Description of Artificial Sequence: Synthetic polypeptide
VELALWYTAGQEDYDRLRPLSYPDTDVILMCFSIDSPDSL

SEQ ID NO: 3355 - protein, 40 aa, Artificial Sequence
  Description of Artificial Sequence: Synthetic polypeptide
VYVPTVFENYVADIEVDGKQVELALWDKAGQEDYDRLRPL

SEQ ID NO: 3356 - protein, 40 aa, Artificial Sequence
  Description of Artificial Sequence: Synthetic polypeptide
DIEVDGKQVELALWDKAGQEDYDRLRPLSYPDTDVILMCF

SEQ ID NO: 3357 - protein, 40 aa, Artificial Sequence
  Description of Artificial Sequence: Synthetic polypeptide
IEVDGKQVELALWDKAGQEDYDRLRPLSYPDTDVILMCFS

SEQ ID NO: 3358 - protein, 40 aa, Artificial Sequence
  Description of Artificial Sequence: Synthetic polypeptide
DGKQVELALWDKAGQEDYDRLRPLSYPDTDVILMCFSIDS

SEQ ID NO: 3359 - protein, 40 aa, Artificial Sequence
  Description of Artificial Sequence: Synthetic polypeptide
VDGKQVELALWDTDGQEDYDRLRPLSYPDTDVILMCFSID

SEQ ID NO: 3360 - protein, 40 aa, Artificial Sequence
  Description of Artificial Sequence: Synthetic polypeptide
LALWDTDGQEDYDRLRPLSYPDTDVILMCFSIDSPDSLEN

SEQ ID NO: 3361 - protein, 40 aa, Artificial Sequence
  Description of Artificial Sequence: Synthetic polypeptide
PEVYVPTVFENYVADIEVDGKQVELALWDTAEQEDYDRLR

SEQ ID NO: 3362 - protein, 40 aa, Artificial Sequence
  Description of Artificial Sequence: Synthetic polypeptide
NYVADIEVDGKQVELALWDTAEQEDYDRLRPLSYPDTDVI

SEQ ID NO: 3363 - protein, 40 aa, Artificial Sequence
  Description of Artificial Sequence: Synthetic polypeptide
DIEVDGKQVELALWDTAEQEDYDRLRPLSYPDTDVILMCF

SEQ ID NO: 3364 - protein, 40 aa, Artificial Sequence
  Description of Artificial Sequence: Synthetic polypeptide
IEVDGKQVELALWDTAEQEDYDRLRPLSYPDTDVILMCFS

SEQ ID NO: 3365 - protein, 40 aa, Artificial Sequence
  Description of Artificial Sequence: Synthetic polypeptide
DIEVDGKQVELALWDTARQEDYDRLRPLSYPDTDVILMCF

SEQ ID NO: 3366 - protein, 40 aa, Artificial Sequence
  Description of Artificial Sequence: Synthetic polypeptide
IEVDGKQVELALWDTARQEDYDRLRPLSYPDTDVILMCFS

SEQ ID NO: 3367 - protein, 40 aa, Artificial Sequence
  Description of Artificial Sequence: Synthetic polypeptide
LALWDTARQEDYDRLRPLSYPDTDVILMCFSIDSPDSLEN

SEQ ID NO: 3368 - protein, 40 aa, Artificial Sequence
  Description of Artificial Sequence: Synthetic polypeptide
YVPTVFENYVADIEVDGKQVELALWDTAGKEDYDRLRPLS

SEQ ID NO: 3369 - protein, 40 aa, Artificial Sequence
  Description of Artificial Sequence: Synthetic polypeptide
DIEVDGKQVELALWDTAGKEDYDRLRPLSYPDTDVILMCF

SEQ ID NO: 3370 - protein, 40 aa, Artificial Sequence
  Description of Artificial Sequence: Synthetic polypeptide
IEVDGKQVELALWDTAGKEDYDRLRPLSYPDTDVILMCFS

SEQ ID NO: 3371 - protein, 40 aa, Artificial Sequence
  Description of Artificial Sequence: Synthetic polypeptide
VDGKQVELALWDTAGKEDYDRLRPLSYPDTDVILMCFSID

SEQ ID NO: 3372 - protein, 40 aa, Artificial Sequence
  Description of Artificial Sequence: Synthetic polypeptide
VELALWDTAGKEDYDRLRPLSYPDTDVILMCFSIDSPDSL

SEQ ID NO: 3373 - protein, 40 aa, Artificial Sequence
  Description of Artificial Sequence: Synthetic polypeptide
LALWDTAGKEDYDRLRPLSYPDTDVILMCFSIDSPDSLEN

SEQ ID NO: 3374 - protein, 40 aa, Artificial Sequence
  Description of Artificial Sequence: Synthetic polypeptide
KEDYDRLRPLSYPDTDVILMCFSIDSPDSLENIPEKWTPE

SEQ ID NO: 3375 - protein, 40 aa, Artificial Sequence
  Description of Artificial Sequence: Synthetic polypeptide
VFENYVADIEVDGKQVELALWDTAGQEDYDRLSPLSYPDT

SEQ ID NO: 3376 - protein, 40 aa, Artificial Sequence
  Description of Artificial Sequence: Synthetic polypeptide
NYVADIEVDGKQVELALWDTAGQEDYDRLSPLSYPDTDVI

SEQ ID NO: 3377 - protein, 40 aa, Artificial Sequence
  Description of Artificial Sequence: Synthetic polypeptide
DIEVDGKQVELALWDTAGQEDYDRLSPLSYPDTDVILMCF

SEQ ID NO: 3378 - protein, 40 aa, Artificial Sequence
  Description of Artificial Sequence: Synthetic polypeptide
QEDYDRLSPLSYPDTDVILMCFSIDSPDSLENIPEKWTPE

SEQ ID NO: 3379 - protein, 40 aa, Artificial Sequence
  Description of Artificial Sequence: Synthetic polypeptide
DYDRLSPLSYPDTDVILMCFSIDSPDSLENIPEKWTPEVK

SEQ ID NO: 3380 - protein, 40 aa, Artificial Sequence
  Description of Artificial Sequence: Synthetic polypeptide
DIEVDGKQVELALWDTAGQEDYDRLRPLPYPDTDVILMCF

SEQ ID NO: 3381 - protein, 40 aa, Artificial Sequence
  Description of Artificial Sequence: Synthetic polypeptide
VDGKQVELALWDTAGQEDYDRLRPLPYPDTDVILMCFSID

SEQ ID NO: 3382 - protein, 40 aa, Artificial Sequence
  Description of Artificial Sequence: Synthetic polypeptide
LALWDTAGQEDYDRLRPLPYPDTDVILMCFSIDSPDSLEN

SEQ ID NO: 3383 - protein, 40 aa, Artificial Sequence
  Description of Artificial Sequence: Synthetic polypeptide
GQEDYDRLRPLPYPDTDVILMCFSIDSPDSLENIPEKWTP

SEQ ID NO: 3384 - protein, 40 aa, Artificial Sequence
  Description of Artificial Sequence: Synthetic polypeptide
EDYDRLRPLPYPDTDVILMCFSIDSPDSLENIPEKWTPEV

SEQ ID NO: 3385 - protein, 40 aa, Artificial Sequence
  Description of Artificial Sequence: Synthetic polypeptide
FKARVKEYARNKNIHYYFMALKNDEIIDATQKGNCSCFMN

SEQ ID NO: 3386 - protein, 40 aa, Artificial Sequence
  Description of Artificial Sequence: Synthetic polypeptide
KARVKEYARNKNIHYYFMALKNDEIIDATQKGNCSCFMNH

SEQ ID NO: 3387 - protein, 40 aa, Artificial Sequence
  Description of Artificial Sequence: Synthetic polypeptide
VKEYARNKNIHYYFMALKNDEIIDATQKGNCSCFMNHSCE

SEQ ID NO: 3388 - protein, 40 aa, Artificial Sequence
  Description of Artificial Sequence: Synthetic polypeptide
YARNKNIHYYFMALKNDEIIDATQKGNCSCFMNHSCEPNC

SEQ ID NO: 3389 - protein, 40 aa, Artificial Sequence
  Description of Artificial Sequence: Synthetic polypeptide
KARVKEYARNKNIHYYFMALKNDEIIDATQKGNCSLFMNH

SEQ ID NO: 3390 - protein, 40 aa, Artificial Sequence
  Description of Artificial Sequence: Synthetic polypeptide
RVKEYARNKNIHYYFMALKNDEIIDATQKGNCSLFMNHSC

SEQ ID NO: 3391 - protein, 40 aa, Artificial Sequence
  Description of Artificial Sequence: Synthetic polypeptide
VKEYARNKNIHYYFMALKNDEIIDATQKGNCSLFMNHSCE

SEQ ID NO: 3392 - protein, 40 aa, Artificial Sequence
  Description of Artificial Sequence: Synthetic polypeptide
KARVKEYARNKNIHYYFMALKNDEIIDATQKGNCSRFMTH

SEQ ID NO: 3393 - protein, 40 aa, Artificial Sequence
  Description of Artificial Sequence: Synthetic polypeptide
VKEYARNKNIHYYFMALKNDEIIDATQKGNCSRFMTHSCE

SEQ ID NO: 3394 - protein, 40 aa, Artificial Sequence
  Description of Artificial Sequence: Synthetic polypeptide
GLATMISTMRPDIDNMDQYVRNTTARAFAVVASALGIPSL

SEQ ID NO: 3395 - protein, 40 aa, Artificial Sequence
  Description of Artificial Sequence: Synthetic polypeptide
LATMISTMRPDIDNMDQYVRNTTARAFAVVASALGIPSLL

SEQ ID NO: 3396 - protein, 40 aa, Artificial Sequence
  Description of Artificial Sequence: Synthetic polypeptide
GLATMISTMRPDIDNMDEYVCNTTARAFAVVASALGIPSL

SEQ ID NO: 3397 - protein, 40 aa, Artificial Sequence
  Description of Artificial Sequence: Synthetic polypeptide
LATMISTMRPDIDNMDEYVCNTTARAFAVVASALGIPSLL

SEQ ID NO: 3398 - protein, 40 aa, Artificial Sequence
  Description of Artificial Sequence: Synthetic polypeptide
PSLLPFLKAVCKSKKSWQARHTGINIVQQIAILMGCAILP

SEQ ID NO: 3399 - protein, 40 aa, Artificial Sequence
  Description of Artificial Sequence: Synthetic polypeptide
TGIKIVQQIAILMGCAILPHLRSLVEIIEHGLVDEQQEVR

SEQ ID NO: 3400 - protein, 40 aa, Artificial Sequence
  Description of Artificial Sequence: Synthetic polypeptide
AALAEAATPYGIESFDSVLKPLWKGIRQHRGEGLAAFLKA

SEQ ID NO: 3401 - protein, 40 aa, Artificial Sequence
  Description of Artificial Sequence: Synthetic polypeptide
LAEAATPYGIESFDSVLKPLWKGIRQHRGKGLAAVLKAIG

SEQ ID NO: 3402 - protein, 40 aa, Artificial Sequence
  Description of Artificial Sequence: Synthetic polypeptide
AVLKAIGYLIPLMDAEYANYYTREVMLILIREFQSPDEEM

SEQ ID NO: 3403 - protein, 40 aa, Artificial Sequence
  Description of Artificial Sequence: Synthetic polypeptide
METIEKIMGNLGAADIDHKLEEQLIDGILYAFQGQTTEDS

SEQ ID NO: 3404 - protein, 40 aa, Artificial Sequence
  Description of Artificial Sequence: Synthetic polypeptide
TIEKIMGNLGAADIDHKLEEQLIDGILYAFQGQTTEDSVM

SEQ ID NO: 3405 - protein, 40 aa, Artificial Sequence
  Description of Artificial Sequence: Synthetic polypeptide
IMGNLGAADIDHKLEEQLIDGILYAFQKQTTEDSVMLNGF

SEQ ID NO: 3406 - protein, 40 aa, Artificial Sequence
  Description of Artificial Sequence: Synthetic polypeptide
AADIDHKLEEQLIDGILYAFQKQTTEDSVMLNGFGTVVNA

SEQ ID NO: 3407 - protein, 40 aa, Artificial Sequence
  Description of Artificial Sequence: Synthetic polypeptide
ADIDHKLEEQLIDGILYAFQKQTTEDSVMLNGFGTVVNAL

SEQ ID NO: 3408 - protein, 40 aa, Artificial Sequence
  Description of Artificial Sequence: Synthetic polypeptide
KIMGNLGAADIDHKLEEQLIDGILYAFQEPTTEDSVMLNG

SEQ ID NO: 3409 - protein, 40 aa, Artificial Sequence
  Description of Artificial Sequence: Synthetic polypeptide
IMGNLGAADIDHKLEEQLIDGILYAFQEPTTEDSVMLNGF

SEQ ID NO: 3410 - protein, 40 aa, Artificial Sequence
  Description of Artificial Sequence: Synthetic polypeptide
ADIDHKLEEQLIDGILYAFQEPTTEDSVMLNGFGTVVNAL

SEQ ID NO: 3411 - protein, 40 aa, Artificial Sequence
  Description of Artificial Sequence: Synthetic polypeptide
SIAYFEMDVQVGETLKVPSSCPIVTVDGYVDPSGGDRFCL

SEQ ID NO: 3412 - protein, 40 aa, Artificial Sequence
  Description of Artificial Sequence: Synthetic polypeptide
NHPAPEYWCSIAYFEMDVQVGETFKVPSSCPIVTVDRYVD

SEQ ID NO: 3413 - protein, 40 aa, Artificial Sequence
  Description of Artificial Sequence: Synthetic polypeptide
CSIAYFEMDVQVGETFKVPSSCPIVTVDGCVDPSGGDRFC

SEQ ID NO: 3414 - protein, 40 aa, Artificial Sequence
  Description of Artificial Sequence: Synthetic polypeptide
PAPEYWCSIAYFEMDVQVGETFKVPSSCPIVTVDGYVVPS

SEQ ID NO: 3415 - protein, 40 aa, Artificial Sequence
  Description of Artificial Sequence: Synthetic polypeptide
CSIAYFEMDVQVGETFKVPSSCPIVTVDGYVVPSGGDRFC

SEQ ID NO: 3416 - protein, 40 aa, Artificial Sequence
  Description of Artificial Sequence: Synthetic polypeptide
NHPAPEYWCSIAYFEMDVQVGETFKVPSSCPIVTVDGYVY

SEQ ID NO: 3417 - protein, 40 aa, Artificial Sequence
  Description of Artificial Sequence: Synthetic polypeptide
PEYWCSIAYFEMDVQVGETFKVPSSCPIVTVDGYVYPSGG

SEQ ID NO: 3418 - protein, 40 aa, Artificial Sequence
  Description of Artificial Sequence: Synthetic polypeptide
APEYWCSIAYFEMDVQVGETFKVPSSCPIVTVDGYVDLSG

SEQ ID NO: 3419 - protein, 40 aa, Artificial Sequence
  Description of Artificial Sequence: Synthetic polypeptide
AYFEMDVQVGETFKVPSSCPIVTVDGYVDPSGGDHFCLGQ

SEQ ID NO: 3420 - protein, 40 aa, Artificial Sequence
  Description of Artificial Sequence: Synthetic polypeptide
GYVDPSGGDRFCLGKLSNVHRTEAIERARLHIGKGVQLEC

SEQ ID NO: 3421 - protein, 40 aa, Artificial Sequence
  Description of Artificial Sequence: Synthetic polypeptide
LCNVHRTEAIERARLHIGKGVQLECKGEGDVWVRCLSDHA

SEQ ID NO: 3422 - protein, 40 aa, Artificial Sequence
  Description of Artificial Sequence: Synthetic polypeptide
RTEAIERARLDIGKGVQLECKGEGDVWVRCLSDHAVFVQS

SEQ ID NO: 3423 - protein, 40 aa, Artificial Sequence
  Description of Artificial Sequence: Synthetic polypeptide
VHRTEAIERARLHIDKGVQLECKGEGDVWVRCLSDHAVFV

SEQ ID NO: 3424 - protein, 40 aa, Artificial Sequence
  Description of Artificial Sequence: Synthetic polypeptide
IERARLHIGKSVQLECKGEGDVWVRCLSDHAVFVQSYYLD

SEQ ID NO: 3425 - protein, 40 aa, Artificial Sequence
  Description of Artificial Sequence: Synthetic polypeptide
VHRTEAIERARLHIGKVVQLECKGEGDVWVRCLSDHAVFV

SEQ ID NO: 3426 - protein, 40 aa, Artificial Sequence
  Description of Artificial Sequence: Synthetic polypeptide
RTEAIERARLHIGKVVQLECKGEGDVWVRCLSDHAVFVQS

SEQ ID NO: 3427 - protein, 40 aa, Artificial Sequence
  Description of Artificial Sequence: Synthetic polypeptide
FVQGKDGGFKKFIRRDFLLDEANGLLPDDKLTLFCEVSVV

SEQ ID NO: 3428 - protein, 40 aa, Artificial Sequence
  Description of Artificial Sequence: Synthetic polypeptide
TYQGSYGFRLGFLHSGTAKYVTCTYSPALNKMFCQLAKTC

SEQ ID NO: 3429 - protein, 40 aa, Artificial Sequence
  Description of Artificial Sequence: Synthetic polypeptide
YGFRLGFLHSGTAKSVTCTSSPALNKMFCQLAKTCPVQLW

SEQ ID NO: 3430 - protein, 40 aa, Artificial Sequence
  Description of Artificial Sequence: Synthetic polypeptide
PSQKTYQGSYGFRLGFLHSGTAKSVTCTYPPALNKMFCQL

SEQ ID NO: 3431 - protein, 40 aa, Artificial Sequence
  Description of Artificial Sequence: Synthetic polypeptide
QGSYGFRLGFLHSGTAKSVTCTYSPALNKMFCQLVKTCPV

SEQ ID NO: 3432 - protein, 40 aa, Artificial Sequence
  Description of Artificial Sequence: Synthetic polypeptide
HHEHCSDSDGLAPPQHLIRVEGNLRVEYLDDRNTFRHSVV

SEQ ID NO: 3433 - protein, 40 aa, Artificial Sequence
  Description of Artificial Sequence: Synthetic polypeptide
APPQHFIRVEGNLRVEYLDDRNTFRHSVVVPYEPPEVGSD

SEQ ID NO: 3434 - protein, 40 aa, Artificial Sequence
  Description of Artificial Sequence: Synthetic polypeptide
LAPPQHLFRVEGNLRVEYLDDRNTFRHSVVVPYEPPEVGS

SEQ ID NO: 3435 - protein, 40 aa, Artificial Sequence
  Description of Artificial Sequence: Synthetic polypeptide
SDGLAPPQHLIRVEGNLRVEYLDGRNTFRHSVVVPYEPPE

SEQ ID NO: 3436 - protein, 40 aa, Artificial Sequence
  Description of Artificial Sequence: Synthetic polypeptide
LAPPQHLIRVEGNLRVEYLDGRNTFRHSVVVPYEPPEVGS

SEQ ID NO: 3437 - protein, 40 aa, Artificial Sequence
  Description of Artificial Sequence: Synthetic polypeptide
LAPPQHLIRVEGNLRVEYLDDRNTFLHSVVVPYEPPEVGS

SEQ ID NO: 3438 - protein, 40 aa, Artificial Sequence
  Description of Artificial Sequence: Synthetic polypeptide
LAPPQHLIRVEGNLRVEYLDDRNTFRHIVVVPYEPPEVGS

SEQ ID NO: 3439 - protein, 40 aa, Artificial Sequence
  Description of Artificial Sequence: Synthetic polypeptide
PPGSTKRALPNNTSSSPQPKKKPLDGEYFTLQIRGREHFE

SEQ ID NO: 3440 - protein, 40 aa, Artificial Sequence
  Description of Artificial Sequence: Synthetic polypeptide
DGLLVYQTELFVPSLNVDGQPIFANITLPVYTLKERCLQV

SEQ ID NO: 3441 - protein, 40 aa, Artificial Sequence
  Description of Artificial Sequence: Synthetic polypeptide
VNQTELFVPSLNVDGQPIFANNTLPVYTLKERCLQVVRSL

SEQ ID NO: 3442 - protein, 40 aa, Artificial Sequence
  Description of Artificial Sequence: Synthetic polypeptide
QTELFVPSLNVDGQPIFANITLPVYTLKEQCLQVVRSLVK

SEQ ID NO: 3443 - protein, 40 aa, Artificial Sequence
  Description of Artificial Sequence: Synthetic polypeptide
HSGNGTFVNTELVGKGKRRPLNNNSEIALSLSRNKVFVFF

SEQ ID NO: 3444 - protein, 40 aa, Artificial Sequence
  Description of Artificial Sequence: Synthetic polypeptide
GTFVNTELVGKGKRRPLNNNSEIALSLSRNKVFVFFDLTV

SEQ ID NO: 3445 - protein, 40 aa, Artificial Sequence
  Description of Artificial Sequence: Synthetic polypeptide
QSKGRARAPISNYIMLADTDKIKSFEEDLKTYKAIEKILR

SEQ ID NO: 3446 - protein, 40 aa, Artificial Sequence
  Description of Artificial Sequence: Synthetic polypeptide
SKGRARAPISNYIMLADTDKIKSFEEDLKTYKAIEKILRN

SEQ ID NO: 3447 - protein, 40 aa, Artificial Sequence
  Description of Artificial Sequence: Synthetic polypeptide
KGRARAPISNYIMLADTDKIKSFEEDLKTYKAIEKILRNK

SEQ ID NO: 3448 - protein, 40 aa, Artificial Sequence
  Description of Artificial Sequence: Synthetic polypeptide
ISGNKNLCYANTINWKKLFGTSGQKTKIISNRGENSCKAT

SEQ ID NO: 3449 - protein, 40 aa, Artificial Sequence
  Description of Artificial Sequence: Synthetic polypeptide
IGGLFILVIVGLTFAVYVRRKSIKKKRALRRFLETELVEP

SEQ ID NO: 3450 - protein, 40 aa, Artificial Sequence
  Description of Artificial Sequence: Synthetic polypeptide
PSGTAPNQAQLRILKETELKRVKVLGSGAFGTVYKGIWVP

SEQ ID NO: 3451 - protein, 40 aa, Artificial Sequence
  Description of Artificial Sequence: Synthetic polypeptide
RILKETELKRVKVLGSGAFGTVYKGIWVPEGETVKIPVAI

SEQ ID NO: 3452 - protein, 40 aa, Artificial Sequence
  Description of Artificial Sequence: Synthetic polypeptide
ETSAKTRQGVDDAFYTLVREIRKHKEKMSKDGKKKKKKSK

SEQ ID NO: 3453 - protein, 40 aa, Artificial Sequence
  Description of Artificial Sequence: Synthetic polypeptide
ETLVRPKPLLLKLLKSVGAQKDTYTMKEVLFYLGQYIMTK

SEQ ID NO: 3454 - protein, 40 aa, Artificial Sequence
  Description of Artificial Sequence: Synthetic polypeptide
MVRPKPLLLKLLKSVGAQKDTYTMKEVLFYLGQYIMTKRL

SEQ ID NO: 3455 - protein, 40 aa, Artificial Sequence
  Description of Artificial Sequence: Synthetic polypeptide
VRPKPLLLKLLKSVGAQKDTYTMKEVLFYLGQYIMTKRLY

SEQ ID NO: 3456 - protein, 40 aa, Artificial Sequence
  Description of Artificial Sequence: Synthetic polypeptide
HTRIIRFCSINSGLHSYMEMPLECILTEKRKKRSTKKEVF

SEQ ID NO: 3457 - protein, 40 aa, Artificial Sequence
  Description of Artificial Sequence: Synthetic polypeptide
RFCSINSGLHSYMEMPLECILTEKRKKRSTKKEVFNILQA

SEQ ID NO: 3458 - protein, 40 aa, Artificial Sequence
  Description of Artificial Sequence: Synthetic polypeptide
HKKTGTTVPESIHSFIGDGLVKPEALNKKAIQIINRVRDK

SEQ ID NO: 3459 - protein, 40 aa, Artificial Sequence
  Description of Artificial Sequence: Synthetic polypeptide
QFNEAQLALIRDIRRRGKNKVAAQNCRKRKLENIVELEQD

SEQ ID NO: 3460 - protein, 40 aa, Artificial Sequence
  Description of Artificial Sequence: Synthetic polypeptide
FNEAQLALIRDIRRRGKNKVAAQNCRKRKLENIVELEQDL

SEQ ID NO: 3461 - protein, 40 aa, Artificial Sequence
  Description of Artificial Sequence: Synthetic polypeptide
FWHLKSEMHNKTVSQRFGLLLESYCRACGMYLKHLNRQVE

SEQ ID NO: 3462 - protein, 40 aa, Artificial Sequence
  Description of Artificial Sequence: Synthetic polypeptide
MHNKTVSQRFGLLLESYCRACGMYLKHLNRQVEAMEKLIN

SEQ ID NO: 3463 - protein, 40 aa, Artificial Sequence
  Description of Artificial Sequence: Synthetic polypeptide
HIDFGHFLDHKKKKFGYKRERVPFVLTQDFLIVISKGAQE

SEQ ID NO: 3464 - protein, 40 aa, Artificial Sequence
  Description of Artificial Sequence: Synthetic polypeptide
RGKSKCVKYWPDEYALKEYGVMRVRNVKESAAHDYTLREL

SEQ ID NO: 3465 - protein, 40 aa, Artificial Sequence
  Description of Artificial Sequence: Synthetic polypeptide
MHDCLMKALKVRGLQPECCAVFRLLHEHKGKKARLDWNTD

SEQ ID NO: 3466 - protein, 40 aa, Artificial Sequence
  Description of Artificial Sequence: Synthetic polypeptide
LMKALKVRGLQPECCAVFRLLHEHKGKKARLDWNTDAASL

SEQ ID NO: 3467 - protein, 40 aa, Artificial Sequence
  Description of Artificial Sequence: Synthetic polypeptide
MKALKVRGLQPECCAVFRLLHEHKGKKARLDWNTDAASLI

SEQ ID NO: 3468 - protein, 40 aa, Artificial Sequence
  Description of Artificial Sequence: Synthetic polypeptide
SDRRPGSFVLSFLSQMNVVNHFRIIAMCGDYYIGGRRFSS

SEQ ID NO: 3469 - protein, 40 aa, Artificial Sequence
  Description of Artificial Sequence: Synthetic polypeptide
DRRPGSFVLSFLSQMNVVNHFRIIAMCGDYYIGGRRFSSL

SEQ ID NO: 3470 - protein, 40 aa, Artificial Sequence
  Description of Artificial Sequence: Synthetic polypeptide
GKEIYNTIRRKTKDAFYKNIVKKGYLLKKGKGKRWKNLYF

SEQ ID NO: 3471 - protein, 40 aa, Artificial Sequence
  Description of Artificial Sequence: Synthetic polypeptide
EIYNTIRRKTKDAFYKNIVKKGYLLKKGKGKRWKNLYFIL

SEQ ID NO: 3472 - protein, 40 aa, Artificial Sequence
  Description of Artificial Sequence: Synthetic polypeptide
IYNTIRRKTKDAFYKNIVKKGYLLKKGKGKRWKNLYFILE

SEQ ID NO: 3473 - protein, 40 aa, Artificial Sequence
  Description of Artificial Sequence: Synthetic polypeptide
YNTIRRKTKDAFYKNIVKKGYLLKKGKGKRWKNLYFILEG

SEQ ID NO: 3474 - protein, 40 aa, Artificial Sequence
  Description of Artificial Sequence: Synthetic polypeptide
NTIRRKTKDAFYKNIVKKGYLLKKGKGKRWKNLYFILEGS

SEQ ID NO: 3475 - protein, 40 aa, Artificial Sequence
  Description of Artificial Sequence: Synthetic polypeptide
TIRRKTKDAFYKNIVKKGYLLKKGKGKRWKNLYFILEGSD

SEQ ID NO: 3476 - protein, 40 aa, Artificial Sequence
  Description of Artificial Sequence: Synthetic polypeptide
RKTKDAFYKNIVKKGYLLKKGKGKRWKNLYFILEGSDAQL

SEQ ID NO: 3477 - protein, 40 aa, Artificial Sequence
  Description of Artificial Sequence: Synthetic polypeptide
KTKDAFYKNIVKKGYLLKKGKGKRWKNLYFILEGSDAQLI

SEQ ID NO: 3478 - protein, 40 aa, Artificial Sequence
  Description of Artificial Sequence: Synthetic polypeptide
TKDAFYKNIVKKGYLLKKGKGKRWKNLYFILEGSDAQLIY

SEQ ID NO: 3479 - protein, 40 aa, Artificial Sequence
  Description of Artificial Sequence: Synthetic polypeptide
KDAFYKNIVKKGYLLKKGKGKRWKNLYFILEGSDAQLIYF

SEQ ID NO: 3480 - protein, 40 aa, Artificial Sequence
  Description of Artificial Sequence: Synthetic polypeptide
DAFYKNIVKKGYLLKKGKGKRWKNLYFILEGSDAQLIYFE

SEQ ID NO: 3481 - protein, 40 aa, Artificial Sequence
  Description of Artificial Sequence: Synthetic polypeptide
AFYKNIVKKGYLLKKGKGKRWKNLYFILEGSDAQLIYFES

SEQ ID NO: 3482 - protein, 40 aa, Artificial Sequence
  Description of Artificial Sequence: Synthetic polypeptide
FYKNIVKKGYLLKKGKGKRWKNLYFILEGSDAQLIYFESE

SEQ ID NO: 3483 - protein, 40 aa, Artificial Sequence
  Description of Artificial Sequence: Synthetic polypeptide
KNIVKKGYLLKKGKGKRWKNLYFILEGSDAQLIYFESEKR

SEQ ID NO: 3484 - protein, 40 aa, Artificial Sequence
  Description of Artificial Sequence: Synthetic polypeptide
NIVKKGYLLKKGKGKRWKNLYFILEGSDAQLIYFESEKRA

SEQ ID NO: 3485 - protein, 40 aa, Artificial Sequence
  Description of Artificial Sequence: Synthetic polypeptide
KKGYLLKKGKGKRWKNLYFILEGSDAQLIYFESEKRATKP

SEQ ID NO: 3486 - protein, 40 aa, Artificial Sequence
  Description of Artificial Sequence: Synthetic polypeptide
GKGKRWKNLYFILEGSDAQLIYFESEKRATKPKGLIDLSV

SEQ ID NO: 3487 - protein, 40 aa, Artificial Sequence
  Description of Artificial Sequence: Synthetic polypeptide
LRKSSPGTSNKRLRQVSSLVLHIEEAHKLPVKHFTNPYCN

SEQ ID NO: 3488 - protein, 40 aa, Artificial Sequence
  Description of Artificial Sequence: Synthetic polypeptide
LPPDINRFEITLSNKTKKSKDPDILFMRCQLSRLQKGHAT

SEQ ID NO: 3489 - protein, 40 aa, Artificial Sequence
  Description of Artificial Sequence: Synthetic polypeptide
INRFEITLSNKTKKSKDPDILFMRCQLSRLQKGHATDEWF

SEQ ID NO: 3490 - protein, 40 aa, Artificial Sequence
  Description of Artificial Sequence: Synthetic polypeptide
NRFEITLSNKTKKSKDPDILFMRCQLSRLQKGHATDEWFL

SEQ ID NO: 3491 - protein, 40 aa, Artificial Sequence
  Description of Artificial Sequence: Synthetic polypeptide
RFEITLSNKTKKSKDPDILFMRCQLSRLQKGHATDEWFLL

SEQ ID NO: 3492 - protein, 40 aa, Artificial Sequence
  Description of Artificial Sequence: Synthetic polypeptide
VHKFFNLLKEIDTSTKVDNAMSRLLKKYDVLFALFSKLER

SEQ ID NO: 3493 - protein, 40 aa, Artificial Sequence
  Description of Artificial Sequence: Synthetic polypeptide
VNPKESILKRVKDIGYIFKEKFAKAVGQGCVEIGSQRYKL

SEQ ID NO: 3494 - protein, 40 aa, Artificial Sequence
  Description of Artificial Sequence: Synthetic polypeptide
QKPLKSTSLSLFYKKVYRLAYLRLNTLCERLLSEHPELEH

SEQ ID NO: 3495 - protein, 40 aa, Artificial Sequence
  Description of Artificial Sequence: Synthetic polypeptide
GQQLARQLKVTYMEASAKIRMNVDQAFHELVRVIRKFQEQ

SEQ ID NO: 3496 - protein, 40 aa, Artificial Sequence
  Description of Artificial Sequence: Synthetic polypeptide
PYGIESFDSVLKPLWKGIRQHRGKGLAAFLKAIGYLIPLM

SEQ ID NO: 3497 - protein, 40 aa, Artificial Sequence
  Description of Artificial Sequence: Synthetic polypeptide
YGIESFDSVLKPLWKGIRQHRGKGLAAFLKAIGYLIPLMD

SEQ ID NO: 3498 - protein, 40 aa, Artificial Sequence
  Description of Artificial Sequence: Synthetic polypeptide
SVLKPLWKGIRQHRGKGLAAFLKAIGYLIPLMDAEYANYY

SEQ ID NO: 3499 - protein, 40 aa, Artificial Sequence
  Description of Artificial Sequence: Synthetic polypeptide
VIQNPGPRHPEAASAAPPGASLLLLQQQQQQQQQQQQQQQ

SEQ ID NO: 3500 - protein, 40 aa, Artificial Sequence
  Description of Artificial Sequence: Synthetic polypeptide
ALSGGGGGGAEPGQALFNGDMEPEAGAGAGAAASSAADPA

SEQ ID NO: 3501 - protein, 40 aa, Artificial Sequence
  Description of Artificial Sequence: Synthetic polypeptide
MSGGGGGGAEPGQALFNGDMEPEAGAGAGAAASSAADPAI

SEQ ID NO: 3502 - protein, 40 aa, Artificial Sequence
  Description of Artificial Sequence: Synthetic polypeptide
SGGGGGGAEPGQALFNGDMEPEAGAGAGAAASSAADPAIP

SEQ ID NO: 3503 - protein, 40 aa, Artificial Sequence
  Description of Artificial Sequence: Synthetic polypeptide
GGGGGAEPGQALFNGDMEPEAGAGAGAAASSAADPAIPEE

SEQ ID NO: 3504 - protein, 40 aa, Artificial Sequence
  Description of Artificial Sequence: Synthetic polypeptide
GGGGAEPGQALFNGDMEPEAGAGAGAAASSAADPAIPEEV

SEQ ID NO: 3505 - protein, 40 aa, Artificial Sequence
  Description of Artificial Sequence: Synthetic polypeptide
GGAEPGQALFNGDMEPEAGAGAGAAASSAADPAIPEEVWN

SEQ ID NO: 3506 - protein, 40 aa, Artificial Sequence
  Description of Artificial Sequence: Synthetic polypeptide
GAEPGQALFNGDMEPEAGAGAGAAASSAADPAIPEEVWNI

SEQ ID NO: 3507 - protein, 40 aa, Artificial Sequence
  Description of Artificial Sequence: Synthetic polypeptide
EPGQALFNGDMEPEAGAGAGAAASSAADPAIPEEVWNIKQ

SEQ ID NO: 3508 - protein, 40 aa, Artificial Sequence
  Description of Artificial Sequence: Synthetic polypeptide
RDQGFRGDGGSTTGLSATPPASLPGSLTNVKALQKSPGPQ

SEQ ID NO: 3509 - protein, 40 aa, Artificial Sequence
  Description of Artificial Sequence: Synthetic polypeptide
MTGQLPYSNINNRDQIIFMVGRGYLSPDLSKVRSNCPKAM

SEQ ID NO: 3510 - protein, 40 aa, Artificial Sequence
  Description of Artificial Sequence: Synthetic polypeptide
QLDSEDLASLKFLSLDYIPQRKQEPIKDALMLFQRLQEKR

SEQ ID NO: 3511 - protein, 40 aa, Artificial Sequence
  Description of Artificial Sequence: Synthetic polypeptide
ASANWTIQYNDPTQESIILKPKMALEVGDYKINLKLMDNQ

SEQ ID NO: 3512 - protein, 40 aa, Artificial Sequence
  Description of Artificial Sequence: Synthetic polypeptide
TFVNTELVGKGKRRPLNNNSEIALSLSRNKVFVFFDLTVD

SEQ ID NO: 3513 - protein, 40 aa, Artificial Sequence
  Description of Artificial Sequence: Synthetic polypeptide
FVNTELVGKGKRRPLNNNSEIALSLSRNKVFVFFDLTVDD

SEQ ID NO: 3514 - protein, 40 aa, Artificial Sequence
  Description of Artificial Sequence: Synthetic polypeptide
TLCGTPTYLAPEVLVSVGTAGYNRAVDCWSLGVILFICLS

SEQ ID NO: 3515 - protein, 40 aa, Artificial Sequence
  Description of Artificial Sequence: Synthetic polypeptide
RDSTLISKQILSDCRAVLVVLGPWCADKVAGMMVRELQKY

SEQ ID NO: 3516 - protein, 40 aa, Artificial Sequence
  Description of Artificial Sequence: Synthetic polypeptide
VIKLLEILRKYKPYERQQFESVEWYNNRNQDNYVSWSDSE

SEQ ID NO: 3517 - protein, 40 aa, Artificial Sequence
  Description of Artificial Sequence: Synthetic polypeptide
PTEYRSYVQSKGRARAPISNYIMLADTDKIKSFEEDLKTY

SEQ ID NO: 3518 - protein, 40 aa, Artificial Sequence
  Description of Artificial Sequence: Synthetic polypeptide
EYRSYVQSKGRARAPISNYIMLADTDKIKSFEEDLKTYKA

SEQ ID NO: 3519 - protein, 40 aa, Artificial Sequence
  Description of Artificial Sequence: Synthetic polypeptide
YRSYVQSKGRARAPISNYIMLADTDKIKSFEEDLKTYKAI

SEQ ID NO: 3520 - protein, 40 aa, Artificial Sequence
  Description of Artificial Sequence: Synthetic polypeptide
YVQSKGRARAPISNYIMLADTDKIKSFEEDLKTYKAIEKI

SEQ ID NO: 3521 - protein, 40 aa, Artificial Sequence
  Description of Artificial Sequence: Synthetic polypeptide
VQSKGRARAPISNYIMLADTDKIKSFEEDLKTYKAIEKIL

SEQ ID NO: 3522 - protein, 40 aa, Artificial Sequence
  Description of Artificial Sequence: Synthetic polypeptide
GRARAPISNYIMLADTDKIKSFEEDLKTYKAIEKILRNKC

SEQ ID NO: 3523 - protein, 40 aa, Artificial Sequence
  Description of Artificial Sequence: Synthetic polypeptide
RARAPISNYIMLADTDKIKSFEEDLKTYKAIEKILRNKCS

SEQ ID NO: 3524 - protein, 40 aa, Artificial Sequence
  Description of Artificial Sequence: Synthetic polypeptide
ARAPISNYIMLADTDKIKSFEEDLKTYKAIEKILRNKCSK

SEQ ID NO: 3525 - protein, 40 aa, Artificial Sequence
  Description of Artificial Sequence: Synthetic polypeptide
RAPISNYIMLADTDKIKSFEEDLKTYKAIEKILRNKCSKS

SEQ ID NO: 3526 - protein, 40 aa, Artificial Sequence
  Description of Artificial Sequence: Synthetic polypeptide
APISNYIMLADTDKIKSFEEDLKTYKAIEKILRNKCSKSV

SEQ ID NO: 3527 - protein, 40 aa, Artificial Sequence
  Description of Artificial Sequence: Synthetic polypeptide
PISNYIMLADTDKIKSFEEDLKTYKAIEKILRNKCSKSVD

SEQ ID NO: 3528 - protein, 40 aa, Artificial Sequence
  Description of Artificial Sequence: Synthetic polypeptide
ISNYIMLADTDKIKSFEEDLKTYKAIEKILRNKCSKSVDT

SEQ ID NO: 3529 - protein, 40 aa, Artificial Sequence
  Description of Artificial Sequence: Synthetic polypeptide
SNYIMLADTDKIKSFEEDLKTYKAIEKILRNKCSKSVDTG

SEQ ID NO: 3530 - protein, 40 aa, Artificial Sequence
  Description of Artificial Sequence: Synthetic polypeptide
NYIMLADTDKIKSFEEDLKTYKAIEKILRNKCSKSVDTGE

SEQ ID NO: 3531 - protein, 40 aa, Artificial Sequence
  Description of Artificial Sequence: Synthetic polypeptide
YIMLADTDKIKSFEEDLKTYKAIEKILRNKCSKSVDTGET

SEQ ID NO: 3532 - protein, 40 aa, Artificial Sequence
  Description of Artificial Sequence: Synthetic polypeptide
EEADYEDDFLEYDQEHIRFIDNMLMGSGAFVKKISLSPFS

SEQ ID NO: 3533 - protein, 40 aa, Artificial Sequence
  Description of Artificial Sequence: Synthetic polypeptide
ADSYEMEEDGVRKCKKCEGPCRKVCNGIGIGEFKDSLSIN

SEQ ID NO: 3534 - protein, 40 aa, Artificial Sequence
  Description of Artificial Sequence: Synthetic polypeptide
KEISDGDVIISGNKNLCYANTINWKKLFGTSGQKTKIISN

SEQ ID NO: 3535 - protein, 40 aa, Artificial Sequence
  Description of Artificial Sequence: Synthetic polypeptide
EISDGDVIISGNKNLCYANTINWKKLFGTSGQKTKIISNR

SEQ ID NO: 3536 - protein, 40 aa, Artificial Sequence
  Description of Artificial Sequence: Synthetic polypeptide
VLGSGAFGTVYKGLWIPEGEKVKIPVAIKELREATSPKAN

SEQ ID NO: 3537 - protein, 40 aa, Artificial Sequence
  Description of Artificial Sequence: Synthetic polypeptide
ALAVLDNGDPLNNTTPVTGASPGGLRELQLRSLTEILKGG

SEQ ID NO: 3538 - protein, 40 aa, Artificial Sequence
  Description of Artificial Sequence: Synthetic polypeptide
LDNGDPLNNTTPVTGASPGGLRELQLRSLTEILKGGVLIQ

SEQ ID NO: 3539 - protein, 40 aa, Artificial Sequence
  Description of Artificial Sequence: Synthetic polypeptide
GDYAAMGACPASEQGYEEMRAFQGPGHQAPHVHYARLKTL

SEQ ID NO: 3540 - protein, 40 aa, Artificial Sequence
  Description of Artificial Sequence: Synthetic polypeptide
DYAAMGACPASEQGYEEMRAFQGPGHQAPHVHYARLKTLR

SEQ ID NO: 3541 - protein, 40 aa, Artificial Sequence
  Description of Artificial Sequence: Synthetic polypeptide
AMGACPASEQGYEEMRAFQGPGHQAPHVHYARLKTLRSLE

SEQ ID NO: 3542 - protein, 40 aa, Artificial Sequence
  Description of Artificial Sequence: Synthetic polypeptide
MGACPASEQGYEEMRAFQGPGHQAPHVHYARLKTLRSLEA

SEQ ID NO: 3543 - protein, 40 aa, Artificial Sequence
  Description of Artificial Sequence: Synthetic polypeptide
ASEQGYEEMRAFQGPGHQAPHVHYARLKTLRSLEATDSAF

SEQ ID NO: 3544 - protein, 40 aa, Artificial Sequence
  Description of Artificial Sequence: Synthetic polypeptide
YEEMRAFQGPGHQAPHVHYARLKTLRSLEATDSAFDNPDY

SEQ ID NO: 3545 - protein, 40 aa, Artificial Sequence
  Description of Artificial Sequence: Synthetic polypeptide
RYALAIFLNYRKDGNFGLQELGLKNLTEILNGGVYVDQNK

SEQ ID NO: 3546 - protein, 40 aa, Artificial Sequence
  Description of Artificial Sequence: Synthetic polypeptide
ALAIFLNYRKDGNFGLQELGLKNLTEILNGGVYVDQNKFL

SEQ ID NO: 3547 - protein, 40 aa, Artificial Sequence
  Description of Artificial Sequence: Synthetic polypeptide
MAIFLNYRKDGNFGLQELGLKNLTEILNGGVYVDQNKFLC

SEQ ID NO: 3548 - protein, 40 aa, Artificial Sequence
  Description of Artificial Sequence: Synthetic polypeptide
GCLLEYVHEHKDNIGSQLLLNWCVQIAKGMMYLEERRLVH

SEQ ID NO: 3549 - protein, 40 aa, Artificial Sequence
  Description of Artificial Sequence: Synthetic polypeptide
PETETCLHTLQGHTNRVYSLQFDGIHVVSGSLDTSIRVWD

SEQ ID NO: 3550 - protein, 40 aa, Artificial Sequence
  Description of Artificial Sequence: Synthetic polypeptide
NRGVVSMVILKMTETQAGEYLLFIQSEATNYTILFTVSIR

SEQ ID NO: 3551 - protein, 40 aa, Artificial Sequence
  Description of Artificial Sequence: Synthetic polypeptide
GEYLLFIQSEATNYTILFTVSIRNTLLYTLRRPYFRKMEN

SEQ ID NO: 3552 - protein, 40 aa, Artificial Sequence
  Description of Artificial Sequence: Synthetic polypeptide
EYLLFIQSEATNYTILFTVSIRNTLLYTLRRPYFRKMENQ

SEQ ID NO: 3553 - protein, 40 aa, Artificial Sequence
  Description of Artificial Sequence: Synthetic polypeptide
YLLFIQSEATNYTILFTVSIRNTLLYTLRRPYFRKMENQD

SEQ ID NO: 3554 - protein, 40 aa, Artificial Sequence
  Description of Artificial Sequence: Synthetic polypeptide
LLFIQSEATNYTILFTVSIRNTLLYTLRRPYFRKMENQDA

SEQ ID NO: 3555 - protein, 40 aa, Artificial Sequence
  Description of Artificial Sequence: Synthetic polypeptide
FIQSEATNYTILFTVSIRNTLLYTLRRPYFRKMENQDALV

SEQ ID NO: 3556 - protein, 40 aa, Artificial Sequence
  Description of Artificial Sequence: Synthetic polypeptide
IQSEATNYTILFTVSIRNTLLYTLRRPYFRKMENQDALVC

SEQ ID NO: 3557 - protein, 40 aa, Artificial Sequence
  Description of Artificial Sequence: Synthetic polypeptide
QSEATNYTILFTVSIRNTLLYTLRRPYFRKMENQDALVCI

SEQ ID NO: 3558 - protein, 40 aa, Artificial Sequence
  Description of Artificial Sequence: Synthetic polypeptide
SEATNYTILFTVSIRNTLLYTLRRPYFRKMENQDALVCIS

SEQ ID NO: 3559 - protein, 40 aa, Artificial Sequence
  Description of Artificial Sequence: Synthetic polypeptide
EATNYTILFTVSIRNTLLYTLRRPYFRKMENQDALVCISE

SEQ ID NO: 3560 - protein, 40 aa, Artificial Sequence
  Description of Artificial Sequence: Synthetic polypeptide
ATNYTILFTVSIRNTLLYTLRRPYFRKMENQDALVCISES

SEQ ID NO: 3561 - protein, 40 aa, Artificial Sequence
  Description of Artificial Sequence: Synthetic polypeptide
TNYTILFTVSIRNTLLYTLRRPYFRKMENQDALVCISESV

SEQ ID NO: 3562 - protein, 40 aa, Artificial Sequence
  Description of Artificial Sequence: Synthetic polypeptide
NYTILFTVSIRNTLLYTLRRPYFRKMENQDALVCISESVP

SEQ ID NO: 3563 - protein, 40 aa, Artificial Sequence
  Description of Artificial Sequence: Synthetic polypeptide
YTILFTVSIRNTLLYTLRRPYFRKMENQDALVCISESVPE

SEQ ID NO: 3564 - protein, 40 aa, Artificial Sequence
  Description of Artificial Sequence: Synthetic polypeptide
TILFTVSIRNTLLYTLRRPYFRKMENQDALVCISESVPEP

SEQ ID NO: 3565 - protein, 40 aa, Artificial Sequence
  Description of Artificial Sequence: Synthetic polypeptide
ILFTVSIRNTLLYTLRRPYFRKMENQDALVCISESVPEPI

SEQ ID NO: 3566 - protein, 40 aa, Artificial Sequence
  Description of Artificial Sequence: Synthetic polypeptide
MFTVSIRNTLLYTLRRPYFRKMENQDALVCISESVPEPIV

SEQ ID NO: 3567 - protein, 40 aa, Artificial Sequence
  Description of Artificial Sequence: Synthetic polypeptide
FTVSIRNTLLYTLRRPYFRKMENQDALVCISESVPEPIVE

SEQ ID NO: 3568 - protein, 40 aa, Artificial Sequence
  Description of Artificial Sequence: Synthetic polypeptide
TVSIRNTLLYTLRRPYFRKMENQDALVCISESVPEPIVEW

SEQ ID NO: 3569 - protein, 40 aa, Artificial Sequence
  Description of Artificial Sequence: Synthetic polypeptide
VSIRNTLLYTLRRPYFRKMENQDALVCISESVPEPIVEWV

SEQ ID NO: 3570 - protein, 40 aa, Artificial Sequence
  Description of Artificial Sequence: Synthetic polypeptide
SIRNTLLYTLRRPYFRKMENQDALVCISESVPEPIVEWVL

SEQ ID NO: 3571 - protein, 40 aa, Artificial Sequence
  Description of Artificial Sequence: Synthetic polypeptide
IRNTLLYTLRRPYFRKMENQDALVCISESVPEPIVEWVLC

SEQ ID NO: 3572 - protein, 40 aa, Artificial Sequence
  Description of Artificial Sequence: Synthetic polypeptide
NTLLYTLRRPYFRKMENQDALVCISESVPEPIVEWVLCDS

SEQ ID NO: 3573 - protein, 40 aa, Artificial Sequence
  Description of Artificial Sequence: Synthetic polypeptide
MRGARGAWDFLCVLLLLLRVQTGSSQPSVSPGEPSPPSIH

SEQ ID NO: 3574 - protein, 40 aa, Artificial Sequence
  Description of Artificial Sequence: Synthetic polypeptide
EHQQWIYMNRTFTDKWEDYPKSENESNIRYVSELHLTRLK

SEQ ID NO: 3575 - protein, 40 aa, Artificial Sequence
  Description of Artificial Sequence: Synthetic polypeptide
MRTGEGFLCVFAINNTKSFEDIHHYREQIKRVKDSEDVPM

SEQ ID NO: 3576 - protein, 40 aa, Artificial Sequence
  Description of Artificial Sequence: Synthetic polypeptide
TGEGFLCVFAINNTKSFEDIHHYREQIKRVKDSEDVPMVL

SEQ ID NO: 3577 - protein, 40 aa, Artificial Sequence
  Description of Artificial Sequence: Synthetic polypeptide
GEGFLCVFAINNTKSFEDIHHYREQIKRVKDSEDVPMVLV

SEQ ID NO: 3578 - protein, 40 aa, Artificial Sequence
  Description of Artificial Sequence: Synthetic polypeptide
EGFLCVFAINNTKSFEDIHHYREQIKRVKDSEDVPMVLVG

SEQ ID NO: 3579 - protein, 40 aa, Artificial Sequence
  Description of Artificial Sequence: Synthetic polypeptide
INNTKSFEDIHHYREQIKRVKDSEDVPMVLVGNKCDLPSR

SEQ ID NO: 3580 - protein, 40 aa, Artificial Sequence
  Description of Artificial Sequence: Synthetic polypeptide
QDFVNKCLIKNPAERADLKQLMVHAFIKRSDAEEVDFAGW

SEQ ID NO: 3581 - protein, 40 aa, Artificial Sequence
  Description of Artificial Sequence: Synthetic polypeptide
IPASEQETLVRPKPLLLKLLKSVGAQKDTYTMKEVLFYLG

SEQ ID NO: 3582 - protein, 40 aa, Artificial Sequence
  Description of Artificial Sequence: Synthetic polypeptide
QETLVRPKPLLLKLLKSVGAQKDTYTMKEVLFYLGQYIMT

SEQ ID NO: 3583 - protein, 40 aa, Artificial Sequence
  Description of Artificial Sequence: Synthetic polypeptide
PKPLLLKLLKSVGAQKDTYTMKEVLFYLGQYIMTKRLYDE

SEQ ID NO: 3584 - protein, 40 aa, Artificial Sequence
  Description of Artificial Sequence: Synthetic polypeptide
SVGAQKDTYTMKEVLFYLGQYIMTKRLYDEKQQHIVYCSN

SEQ ID NO: 3585 - protein, 40 aa, Artificial Sequence
  Description of Artificial Sequence: Synthetic polypeptide
AQKDTYTMKEVLFYLGQYIMTKRLYDEKQQHIVYCSNDLL

SEQ ID NO: 3586 - protein, 40 aa, Artificial Sequence
  Description of Artificial Sequence: Synthetic polypeptide
TYTMKEVLFYLGQYIMTKRLYDEKQQHIVYCSNDLLGDLF

SEQ ID NO: 3587 - protein, 40 aa, Artificial Sequence
  Description of Artificial Sequence: Synthetic polypeptide
YTMKEVLFYLGQYIMTKRLYDEKQQHIVYCSNDLLGDLFG

SEQ ID NO: 3588 - protein, 40 aa, Artificial Sequence
  Description of Artificial Sequence: Synthetic polypeptide
MFGVPSFSVKEHRKIYTMIYRNLVVVNQQESSDSGTSVSE

SEQ ID NO: 3589 - protein, 40 aa, Artificial Sequence
  Description of Artificial Sequence: Synthetic polypeptide
LGVGIKVEAADTEQTSEEVGKVSDKKVIEVGKNDDLEDSK

SEQ ID NO: 3590 - protein, 40 aa, Artificial Sequence
  Description of Artificial Sequence: Synthetic polypeptide
GIKVEAADTEQTSEEVGKVSDKKVIEVGKNDDLEDSKSLS

SEQ ID NO: 3591 - protein, 40 aa, Artificial Sequence
  Description of Artificial Sequence: Synthetic polypeptide
IKVEAADTEQTSEEVGKVSDKKVIEVGKNDDLEDSKSLSD

SEQ ID NO: 3592 - protein, 40 aa, Artificial Sequence
  Description of Artificial Sequence: Synthetic polypeptide
KVEAADTEQTSEEVGKVSDKKVIEVGKNDDLEDSKSLSDD

SEQ ID NO: 3593 - protein, 40 aa, Artificial Sequence
  Description of Artificial Sequence: Synthetic polypeptide
ADTEQTSEEVGKVSDKKVIEVGKNDDLEDSKSLSDDTDVE

SEQ ID NO: 3594 - protein, 40 aa, Artificial Sequence
  Description of Artificial Sequence: Synthetic polypeptide
EQTSEEVGKVSDKKVIEVGKNDDLEDSKSLSDDTDVEVTS

SEQ ID NO: 3595 - protein, 40 aa, Artificial Sequence
  Description of Artificial Sequence: Synthetic polypeptide
EKENEGNDVPDCRRTISAPVVRPKDAYIKKENSKLFDPCN

SEQ ID NO: 3596 - protein, 40 aa, Artificial Sequence
  Description of Artificial Sequence: Synthetic polypeptide
KYFDLIYVHNPVFKPFEKPVMISMGNENVLEIKGNDIDPE

SEQ ID NO: 3597 - protein, 40 aa, Artificial Sequence
  Description of Artificial Sequence: Synthetic polypeptide
MISMGNENVLEIKGNDIDPEAVKGEVLKVGNKSCENIHLH

SEQ ID NO: 3598 - protein, 40 aa, Artificial Sequence
  Description of Artificial Sequence: Synthetic polypeptide
GNENVLEIKGNDIDPEAVKGEVLKVGNKSCENIHLHSEAV

SEQ ID NO: 3599 - protein, 40 aa, Artificial Sequence
  Description of Artificial Sequence: Synthetic polypeptide
QAVQHVVIGPSSLIVHFNEVIGRGHFGCVYHGTLLDNDGK

SEQ ID NO: 3600 - protein, 40 aa, Artificial Sequence
  Description of Artificial Sequence: Synthetic polypeptide
IFSTFIGEHYVHVNATYVNVKCVAPYPSLLSSEDNADDEV

SEQ ID NO: 3601 - protein, 40 aa, Artificial Sequence
  Description of Artificial Sequence: Synthetic polypeptide
ILKALILKLKDPDPDPNPGVINNVLATIGELAQVSGLEMR

SEQ ID NO: 3602 - protein, 40 aa, Artificial Sequence
  Description of Artificial Sequence: Synthetic polypeptide
PFPVNKREPAPVPAAPASAPAAGPAVASGAGIAAPAGAPG

SEQ ID NO: 3603 - protein, 40 aa, Artificial Sequence
  Description of Artificial Sequence: Synthetic polypeptide
SGKVVNIDTNSLRSSMRPGFEDIIRRCIQRFFSLNDGQSW

SEQ ID NO: 3604 - protein, 40 aa, Artificial Sequence
  Description of Artificial Sequence: Synthetic polypeptide
DIDLGVSREVFDFSQRRKEYELEKQKKLEKERQEQLQKEQ

SEQ ID NO: 3605 - protein, 40 aa, Artificial Sequence
  Description of Artificial Sequence: Synthetic polypeptide
IDLGVSREVFDFSQRRKEYELEKQKKLEKERQEQLQKEQE

SEQ ID NO: 3606 - protein, 40 aa, Artificial Sequence
  Description of Artificial Sequence: Synthetic polypeptide
LGVSREVFDFSQRRKEYELEKQKKLEKERQEQLQKEQEKA

SEQ ID NO: 3607 - protein, 40 aa, Artificial Sequence
  Description of Artificial Sequence: Synthetic polypeptide
GVSREVFDFSQRRKEYELEKQKKLEKERQEQLQKEQEKAF

SEQ ID NO: 3608 - protein, 40 aa, Artificial Sequence
  Description of Artificial Sequence: Synthetic polypeptide
VSREVFDFSQRRKEYELEKQKKLEKERQEQLQKEQEKAFF

SEQ ID NO: 3609 - protein, 40 aa, Artificial Sequence
  Description of Artificial Sequence: Synthetic polypeptide
EVFDFSQRRKEYELEKQKKLEKERQEQLQKEQEKAFFAQL

SEQ ID NO: 3610 - protein, 40 aa, Artificial Sequence
  Description of Artificial Sequence: Synthetic polypeptide
QRRKEYELEKQKKLEKERQEQLQKEQEKAFFAQLQLDEET

SEQ ID NO: 3611 - protein, 40 aa, Artificial Sequence
  Description of Artificial Sequence: Synthetic polypeptide
RRKEYELEKQKKLEKERQEQLQKEQEKAFFAQLQLDEETG

SEQ ID NO: 3612 - protein, 40 aa, Artificial Sequence
  Description of Artificial Sequence: Synthetic polypeptide
RKEYELEKQKKLEKERQEQLQKEQEKAFFAQLQLDEETGE

SEQ ID NO: 3613 - protein, 40 aa, Artificial Sequence
  Description of Artificial Sequence: Synthetic polypeptide
KEYELEKQKKLEKERQEQLQKEQEKAFFAQLQLDEETGEF

SEQ ID NO: 3614 - protein, 40 aa, Artificial Sequence
  Description of Artificial Sequence: Synthetic polypeptide
EYELEKQKKLEKERQEQLQKEQEKAFFAQLQLDEETGEFL

SEQ ID NO: 3615 - protein, 40 aa, Artificial Sequence
  Description of Artificial Sequence: Synthetic polypeptide
YELEKQKKLEKERQEQLQKEQEKAFFAQLQLDEETGEFLP

SEQ ID NO: 3616 - protein, 40 aa, Artificial Sequence
  Description of Artificial Sequence: Synthetic polypeptide
KLVETTMVPSPEAKLTEVDNYHFYSSIPSMEKEVGNCSPH

SEQ ID NO: 3617 - protein, 40 aa, Artificial Sequence
  Description of Artificial Sequence: Synthetic polypeptide
VETTMVPSPEAKLTEVDNYHFYSSIPSMEKEVGNCSPHFL

SEQ ID NO: 3618 - protein, 40 aa, Artificial Sequence
  Description of Artificial Sequence: Synthetic polypeptide
NCRKRKLENIVELEQDLDHLKDEKEKLLKEKGENDKSLHL

SEQ ID NO: 3619 - protein, 40 aa, Artificial Sequence
  Description of Artificial Sequence: Synthetic polypeptide
NIVELEQDLDHLKDEKEKLLKEKGENDKSLHLLKKQLSTL

SEQ ID NO: 3620 - protein, 40 aa, Artificial Sequence
  Description of Artificial Sequence: Synthetic polypeptide
VELEQDLDHLKDEKEKLLKEKGENDKSLHLLKKQLSTLYL

SEQ ID NO: 3621 - protein, 40 aa, Artificial Sequence
  Description of Artificial Sequence: Synthetic polypeptide
ELEQDLDHLKDEKEKLLKEKGENDKSLHLLKKQLSTLYLE

SEQ ID NO: 3622 - protein, 40 aa, Artificial Sequence
  Description of Artificial Sequence: Synthetic polypeptide
EQDLDHLKDEKEKLLKEKGENDKSLHLLKKQLSTLYLEVF

SEQ ID NO: 3623 - protein, 40 aa, Artificial Sequence
  Description of Artificial Sequence: Synthetic polypeptide
QDLDHLKDEKEKLLKEKGENDKSLHLLKKQLSTLYLEVFS

SEQ ID NO: 3624 - protein, 40 aa, Artificial Sequence
  Description of Artificial Sequence: Synthetic polypeptide
DLDHLKDEKEKLLKEKGENDKSLHLLKKQLSTLYLEVFSM

SEQ ID NO: 3625 - protein, 40 aa, Artificial Sequence
  Description of Artificial Sequence: Synthetic polypeptide
LDHLKDEKEKLLKEKGENDKSLHLLKKQLSTLYLEVFSML

SEQ ID NO: 3626 - protein, 40 aa, Artificial Sequence
  Description of Artificial Sequence: Synthetic polypeptide
DHLKDEKEKLLKEKGENDKSLHLLKKQLSTLYLEVFSMLR

SEQ ID NO: 3627 - protein, 40 aa, Artificial Sequence
  Description of Artificial Sequence: Synthetic polypeptide
HLKDEKEKLLKEKGENDKSLHLLKKQLSTLYLEVFSMLRD

SEQ ID NO: 3628 - protein, 40 aa, Artificial Sequence
  Description of Artificial Sequence: Synthetic polypeptide
MKDEKEKLLKEKGENDKSLHLLKKQLSTLYLEVFSMLRDE

SEQ ID NO: 3629 - protein, 40 aa, Artificial Sequence
  Description of Artificial Sequence: Synthetic polypeptide
KDEKEKLLKEKGENDKSLHLLKKQLSTLYLEVFSMLRDED

SEQ ID NO: 3630 - protein, 40 aa, Artificial Sequence
  Description of Artificial Sequence: Synthetic polypeptide
DEKEKLLKEKGENDKSLHLLKKQLSTLYLEVFSMLRDEDG

SEQ ID NO: 3631 - protein, 40 aa, Artificial Sequence
  Description of Artificial Sequence: Synthetic polypeptide
EKEKLLKEKGENDKSLHLLKKQLSTLYLEVFSMLRDEDGK

SEQ ID NO: 3632 - protein, 40 aa, Artificial Sequence
  Description of Artificial Sequence: Synthetic polypeptide
KEKLLKEKGENDKSLHLLKKQLSTLYLEVFSMLRDEDGKP

SEQ ID NO: 3633 - protein, 40 aa, Artificial Sequence
  Description of Artificial Sequence: Synthetic polypeptide
EKLLKEKGENDKSLHLLKKQLSTLYLEVFSMLRDEDGKPY

SEQ ID NO: 3634 - protein, 40 aa, Artificial Sequence
  Description of Artificial Sequence: Synthetic polypeptide
KLLKEKGENDKSLHLLKKQLSTLYLEVFSMLRDEDGKPYS

SEQ ID NO: 3635 - protein, 40 aa, Artificial Sequence
  Description of Artificial Sequence: Synthetic polypeptide
ATLITIKHELFKEARKYPLHQLLQDESSYIFVSVTQEAER

SEQ ID NO: 3636 - protein, 40 aa, Artificial Sequence
  Description of Artificial Sequence: Synthetic polypeptide
TLITIKHELFKEARKYPLHQLLQDESSYIFVSVTQEAERE

SEQ ID NO: 3637 - protein, 40 aa, Artificial Sequence
  Description of Artificial Sequence: Synthetic polypeptide
LHQLLQDESSYIFVSVTQEAEREEFFDETRRLCDLRLFQP

SEQ ID NO: 3638 - protein, 40 aa, Artificial Sequence
  Description of Artificial Sequence: Synthetic polypeptide
SRAMYVYPPNVESSPELPKHIYNKLDKGQIIVVIWVIVSP

SEQ ID NO: 3639 - protein, 40 aa, Artificial Sequence
  Description of Artificial Sequence: Synthetic polypeptide
RAMYVYPPNVESSPELPKHIYNKLDKGQIIVVIWVIVSPN

SEQ ID NO: 3640 - protein, 40 aa, Artificial Sequence
  Description of Artificial Sequence: Synthetic polypeptide
YVYPPNVESSPELPKHIYNKLDKGQIIVVIWVIVSPNNDK

SEQ ID NO: 3641 - protein, 40 aa, Artificial Sequence
  Description of Artificial Sequence: Synthetic polypeptide
NVESSPELPKHIYNKLDKGQIIVVIWVIVSPNNDKQKYTL

SEQ ID NO: 3642 - protein, 40 aa, Artificial Sequence
  Description of Artificial Sequence: Synthetic polypeptide
EAIRKKTRSMLLSSEQLKLCVLEYQGKYILKVCGCDEYFL

SEQ ID NO: 3643 - protein, 40 aa, Artificial Sequence
  Description of Artificial Sequence: Synthetic polypeptide
KKTRSMLLSSEQLKLCVLEYQGKYILKVCGCDEYFLEKYP

SEQ ID NO: 3644 - protein, 40 aa, Artificial Sequence
  Description of Artificial Sequence: Synthetic polypeptide
QLKLCVLEYQGKYILKVCGCDEYFLEKYPLSQYKYIRSCI

SEQ ID NO: 3645 - protein, 40 aa, Artificial Sequence
  Description of Artificial Sequence: Synthetic polypeptide
NIRDIDKIYVRTGIYHGGEPLCDNVNTQRVPCSNPRWNEW

SEQ ID NO: 3646 - protein, 40 aa, Artificial Sequence
  Description of Artificial Sequence: Synthetic polypeptide
MDCNYPDPMVRGFAVRCLEKYLTDDKLSQYLIQLVQVLKY

SEQ ID NO: 3647 - protein, 40 aa, Artificial Sequence
  Description of Artificial Sequence: Synthetic polypeptide
PMVRGFAVRCLEKYLTDDKLSQYLIQLVQVLKYEQYLDNL

SEQ ID NO: 3648 - protein, 40 aa, Artificial Sequence
  Description of Artificial Sequence: Synthetic polypeptide
EMHNKTVSQRFGLLLESYCRACGMYLKHLNRQVEAMEKLI

SEQ ID NO: 3649 - protein, 40 aa, Artificial Sequence
  Description of Artificial Sequence: Synthetic polypeptide
RIMENIWQNQGLDLRMLPYGCLSIGDCVGLIEVVRNSHTI

SEQ ID NO: 3650 - protein, 40 aa, Artificial Sequence
  Description of Artificial Sequence: Synthetic polypeptide
FERFQEMCYKAYLAIRQHANLFINLFSMMLGSGMPELQSF

SEQ ID NO: 3651 - protein, 40 aa, Artificial Sequence
  Description of Artificial Sequence: Synthetic polypeptide
YPVSKYQQDQVVKEDNIEAVGKKLHEYNTQFQEKSREYDR

SEQ ID NO: 3652 - protein, 40 aa, Artificial Sequence
  Description of Artificial Sequence: Synthetic polypeptide
SKYQQDQVVKEDNIEAVGKKLHEYNTQFQEKSREYDRLYE

SEQ ID NO: 3653 - protein, 40 aa, Artificial Sequence
  Description of Artificial Sequence: Synthetic polypeptide
IEAVGKKLHEYNTQFQEKSREYDRLYEEYTRTSQEIQMKR

SEQ ID NO: 3654 - protein, 40 aa, Artificial Sequence
  Description of Artificial Sequence: Synthetic polypeptide
FNETIKIFEEQCQTQERYSKEYIEKFKREGNEKEIQRIMH

SEQ ID NO: 3655 - protein, 40 aa, Artificial Sequence
  Description of Artificial Sequence: Synthetic polypeptide
NLLRGKRDGTFLVRESSKQGCYACSVVVDGEVKHCVINKT

SEQ ID NO: 3656 - protein, 40 aa, Artificial Sequence
  Description of Artificial Sequence: Synthetic polypeptide
EACVNIAQLLPQEDLEALVMPTLRQAAEDKSWRVRYMVAD

SEQ ID NO: 3657 - protein, 40 aa, Artificial Sequence
  Description of Artificial Sequence: Synthetic polypeptide
GMVQTEAQYRFIYMAVQHYIETLQRRIEEEQKSKRKGHEY

SEQ ID NO: 3658 - protein, 40 aa, Artificial Sequence
  Description of Artificial Sequence: Synthetic polypeptide
EDYDRLRPLSYPQTVGETYGKDITSRGKDKPIADVFLICF

SEQ ID NO: 3659 - protein, 40 aa, Artificial Sequence
  Description of Artificial Sequence: Synthetic polypeptide
DRLRPLSYPQTVGETYGKDITSRGKDKPIADVFLICFSLV

SEQ ID NO: 3660 - protein, 40 aa, Artificial Sequence
  Description of Artificial Sequence: Synthetic polypeptide
LRPLSYPQTVGETYGKDITSRGKDKPIADVFLICFSLVSP

SEQ ID NO: 3661 - protein, 40 aa, Artificial Sequence
  Description of Artificial Sequence: Synthetic polypeptide
YPQTVGETYGKDITSRGKDKPIADVFLICFSLVSPASFEN

SEQ ID NO: 3662 - protein, 40 aa, Artificial Sequence
  Description of Artificial Sequence: Synthetic polypeptide
GSYLIRESDRRPGSFVLSFLSQMNVVNHFRIIAMCGDYYI

SEQ ID NO: 3663 - protein, 40 aa, Artificial Sequence
  Description of Artificial Sequence: Synthetic polypeptide
SYLIRESDRRPGSFVLSFLSQMNVVNHFRIIAMCGDYYIG

SEQ ID NO: 3664 - protein, 40 aa, Artificial Sequence
  Description of Artificial Sequence: Synthetic polypeptide
IVVQHFSEEHYIFYFAGETPEQAEDWMKGLQAFCNLRKSS

SEQ ID NO: 3665 - protein, 40 aa, Artificial Sequence
  Description of Artificial Sequence: Synthetic polypeptide
VVQHFSEEHYIFYFAGETPEQAEDWMKGLQAFCNLRKSSP

SEQ ID NO: 3666 - protein, 40 aa, Artificial Sequence
  Description of Artificial Sequence: Synthetic polypeptide
SEEFVFDDLPPDINRFEITLSNKTKKSKDPDILFMRCQLS

SEQ ID NO: 3667 - protein, 40 aa, Artificial Sequence
  Description of Artificial Sequence: Synthetic polypeptide
EEFVFDDLPPDINRFEITLSNKTKKSKDPDILFMRCQLSR

SEQ ID NO: 3668 - protein, 40 aa, Artificial Sequence
  Description of Artificial Sequence: Synthetic polypeptide
EFVFDDLPPDINRFEITLSNKTKKSKDPDILFMRCQLSRL

SEQ ID NO: 3669 - protein, 40 aa, Artificial Sequence
  Description of Artificial Sequence: Synthetic polypeptide
FVFDDLPPDINRFEITLSNKTKKSKDPDILFMRCQLSRLQ

SEQ ID NO: 3670 - protein, 40 aa, Artificial Sequence
  Description of Artificial Sequence: Synthetic polypeptide
VFDDLPPDINRFEITLSNKTKKSKDPDILFMRCQLSRLQK

SEQ ID NO: 3671 - protein, 40 aa, Artificial Sequence
  Description of Artificial Sequence: Synthetic polypeptide
FDDLPPDINRFEITLSNKTKKSKDPDILFMRCQLSRLQKG

SEQ ID NO: 3672 - protein, 40 aa, Artificial Sequence
  Description of Artificial Sequence: Synthetic polypeptide
ICVAHSDELRTLSNERGAQQHVLKKLLAITELLQQKQNQY

SEQ ID NO: 3673 - protein, 40 aa, Artificial Sequence
  Description of Artificial Sequence: Synthetic polypeptide
VAHSDELRTLSNERGAQQHVLKKLLAITELLQQKQNQYTK

SEQ ID NO: 3674 - protein, 40 aa, Artificial Sequence
  Description of Artificial Sequence: Synthetic polypeptide
AHSDELRTLSNERGAQQHVLKKLLAITELLQQKQNQYTKT

SEQ ID NO: 3675 - protein, 40 aa, Artificial Sequence
  Description of Artificial Sequence: Synthetic polypeptide
MGGYIQKKKELWGICIFIAAVDLDEMSFTFTELQKNIEIS

SEQ ID NO: 3676 - protein, 40 aa, Artificial Sequence
  Description of Artificial Sequence: Synthetic polypeptide
SKLERTCELIYLTQPSSSISTEINSALVLKVSWITFLLAK

SEQ ID NO: 3677 - protein, 40 aa, Artificial Sequence
  Description of Artificial Sequence: Synthetic polypeptide
KLERTCELIYLTQPSSSISTEINSALVLKVSWITFLLAKG

SEQ ID NO: 3678 - protein, 40 aa, Artificial Sequence
  Description of Artificial Sequence: Synthetic polypeptide
MERTCELIYLTQPSSSISTEINSALVLKVSWITFLLAKGE

SEQ ID NO: 3679 - protein, 40 aa, Artificial Sequence
  Description of Artificial Sequence: Synthetic polypeptide
TCELIYLTQPSSSISTEINSALVLKVSWITFLLAKGEVLQ

SEQ ID NO: 3680 - protein, 40 aa, Artificial Sequence
  Description of Artificial Sequence: Synthetic polypeptide
TQPSSSISTEINSALVLKVSWITFLLAKGEVLQMEDDLVI

SEQ ID NO: 3681 - protein, 40 aa, Artificial Sequence
  Description of Artificial Sequence: Synthetic polypeptide
EINSALVLKVSWITFLLAKGEVLQMEDDLVISFQLMLCVL

SEQ ID NO: 3682 - protein, 40 aa, Artificial Sequence
  Description of Artificial Sequence: Synthetic polypeptide
MVLKVSWITFLLAKGEVLQMEDDLVISFQLMLCVLDYFIK

SEQ ID NO: 3683 - protein, 40 aa, Artificial Sequence
  Description of Artificial Sequence: Synthetic polypeptide
VLKVSWITFLLAKGEVLQMEDDLVISFQLMLCVLDYFIKL

SEQ ID NO: 3684 - protein, 40 aa, Artificial Sequence
  Description of Artificial Sequence: Synthetic polypeptide
ARIAKQLENDTRIIEVLCKEHECNIDEVKNVYFKNFIPFM

SEQ ID NO: 3685 - protein, 40 aa, Artificial Sequence
  Description of Artificial Sequence: Synthetic polypeptide
RIAKQLENDTRIIEVLCKEHECNIDEVKNVYFKNFIPFMN

SEQ ID NO: 3686 - protein, 40 aa, Artificial Sequence
  Description of Artificial Sequence: Synthetic polypeptide
AKQLENDTRIIEVLCKEHECNIDEVKNVYFKNFIPFMNSL

SEQ ID NO: 3687 - protein, 40 aa, Artificial Sequence
  Description of Artificial Sequence: Synthetic polypeptide
KQLENDTRIIEVLCKEHECNIDEVKNVYFKNFIPFMNSLG

SEQ ID NO: 3688 - protein, 40 aa, Artificial Sequence
  Description of Artificial Sequence: Synthetic polypeptide
QLENDTRIIEVLCKEHECNIDEVKNVYFKNFIPFMNSLGL

SEQ ID NO: 3689 - protein, 40 aa, Artificial Sequence
  Description of Artificial Sequence: Synthetic polypeptide
NDTRIIEVLCKEHECNIDEVKNVYFKNFIPFMNSLGLVTS

SEQ ID NO: 3690 - protein, 40 aa, Artificial Sequence
  Description of Artificial Sequence: Synthetic polypeptide
RIIEVLCKEHECNIDEVKNVYFKNFIPFMNSLGLVTSNGL

SEQ ID NO: 3691 - protein, 40 aa, Artificial Sequence
  Description of Artificial Sequence: Synthetic polypeptide
IIEVLCKEHECNIDEVKNVYFKNFIPFMNSLGLVTSNGLP

SEQ ID NO: 3692 - protein, 40 aa, Artificial Sequence
  Description of Artificial Sequence: Synthetic polypeptide
VLCKEHECNIDEVKNVYFKNFIPFMNSLGLVTSNGLPEVE

SEQ ID NO: 3693 - protein, 40 aa, Artificial Sequence
  Description of Artificial Sequence: Synthetic polypeptide
LCKEHECNIDEVKNVYFKNFIPFMNSLGLVTSNGLPEVEN

SEQ ID NO: 3694 - protein, 40 aa, Artificial Sequence
  Description of Artificial Sequence: Synthetic polypeptide
CKEHECNIDEVKNVYFKNFIPFMNSLGLVTSNGLPEVENL

SEQ ID NO: 3695 - protein, 40 aa, Artificial Sequence
  Description of Artificial Sequence: Synthetic polypeptide
KEHECNIDEVKNVYFKNFIPFMNSLGLVTSNGLPEVENLS

SEQ ID NO: 3696 - protein, 40 aa, Artificial Sequence
  Description of Artificial Sequence: Synthetic polypeptide
EHECNIDEVKNVYFKNFIPFMNSLGLVTSNGLPEVENLSK

SEQ ID NO: 3697 - protein, 40 aa, Artificial Sequence
  Description of Artificial Sequence: Synthetic polypeptide
HECNIDEVKNVYFKNFIPFMNSLGLVTSNGLPEVENLSKR

SEQ ID NO: 3698 - protein, 40 aa, Artificial Sequence
  Description of Artificial Sequence: Synthetic polypeptide
ECNIDEVKNVYFKNFIPFMNSLGLVTSNGLPEVENLSKRY

SEQ ID NO: 3699 - protein, 40 aa, Artificial Sequence
  Description of Artificial Sequence: Synthetic polypeptide
NIDEVKNVYFKNFIPFMNSLGLVTSNGLPEVENLSKRYEE

SEQ ID NO: 3700 - protein, 40 aa, Artificial Sequence
  Description of Artificial Sequence: Synthetic polypeptide
IDEVKNVYFKNFIPFMNSLGLVTSNGLPEVENLSKRYEEI

SEQ ID NO: 3701 - protein, 40 aa, Artificial Sequence
  Description of Artificial Sequence: Synthetic polypeptide
DEVKNVYFKNFIPFMNSLGLVTSNGLPEVENLSKRYEEIY

SEQ ID NO: 3702 - protein, 40 aa, Artificial Sequence
  Description of Artificial Sequence: Synthetic polypeptide
EVKNVYFKNFIPFMNSLGLVTSNGLPEVENLSKRYEEIYL

SEQ ID NO: 3703 - protein, 40 aa, Artificial Sequence
  Description of Artificial Sequence: Synthetic polypeptide
SLGLVTSNGLPEVENLSKRYEEIYLKNKDLDARLFLDHDK

SEQ ID NO: 3704 - protein, 40 aa, Artificial Sequence
  Description of Artificial Sequence: Synthetic polypeptide
GLVTSNGLPEVENLSKRYEEIYLKNKDLDARLFLDHDKTL

SEQ ID NO: 3705 - protein, 40 aa, Artificial Sequence
  Description of Artificial Sequence: Synthetic polypeptide
LVTSNGLPEVENLSKRYEEIYLKNKDLDARLFLDHDKTLQ

SEQ ID NO: 3706 - protein, 40 aa, Artificial Sequence
  Description of Artificial Sequence: Synthetic polypeptide
NGLPEVENLSKRYEEIYLKNKDLDARLFLDHDKTLQTDSI

SEQ ID NO: 3707 - protein, 40 aa, Artificial Sequence
  Description of Artificial Sequence: Synthetic polypeptide
ENLSKRYEEIYLKNKDLDARLFLDHDKTLQTDSIDSFETQ

SEQ ID NO: 3708 - protein, 40 aa, Artificial Sequence
  Description of Artificial Sequence: Synthetic polypeptide
YEEIYLKNKDLDARLFLDHDKTLQTDSIDSFETQRTPRKS

SEQ ID NO: 3709 - protein, 40 aa, Artificial Sequence
  Description of Artificial Sequence: Synthetic polypeptide
EEIYLKNKDLDARLFLDHDKTLQTDSIDSFETQRTPRKSN

SEQ ID NO: 3710 - protein, 40 aa, Artificial Sequence
  Description of Artificial Sequence: Synthetic polypeptide
EIYLKNKDLDARLFLDHDKTLQTDSIDSFETQRTPRKSNL

SEQ ID NO: 3711 - protein, 40 aa, Artificial Sequence
  Description of Artificial Sequence: Synthetic polypeptide
IYLKNKDLDARLFLDHDKTLQTDSIDSFETQRTPRKSNLD

SEQ ID NO: 3712 - protein, 40 aa, Artificial Sequence
  Description of Artificial Sequence: Synthetic polypeptide
MSLLACALEVVMATYSRSTSQNLDSGTDLSFPWILNVLNL

SEQ ID NO: 3713 - protein, 40 aa, Artificial Sequence
  Description of Artificial Sequence: Synthetic polypeptide
DLSFPWILNVLNLKAFDFYKVIESFIKAEGNLTREMIKHL

SEQ ID NO: 3714 - protein, 40 aa, Artificial Sequence
  Description of Artificial Sequence: Synthetic polypeptide
GFLLVFSVTDRGSFEEIYKFQRQILRVKDRDEFPMILIGN

SEQ ID NO: 3715 - protein, 40 aa, Artificial Sequence
  Description of Artificial Sequence: Synthetic polypeptide
VFSVTDRGSFEEIYKFQRQILRVKDRDEFPMILIGNKADL

SEQ ID NO: 3716 - protein, 40 aa, Artificial Sequence
  Description of Artificial Sequence: Synthetic polypeptide
GSFEEIYKFQRQILRVKDRDEFPMILIGNKADLDHQRQVT

SEQ ID NO: 3717 - protein, 40 aa, Artificial Sequence
  Description of Artificial Sequence: Synthetic polypeptide
SFEEIYKFQRQILRVKDRDEFPMILIGNKADLDHQRQVTQ

SEQ ID NO: 3718 - protein, 40 aa, Artificial Sequence
  Description of Artificial Sequence: Synthetic polypeptide
RVKDRDEFPMILIGNKADLDHQRQVTQEEGQQLARQLKVT

SEQ ID NO: 3719 - protein, 40 aa, Artificial Sequence
  Description of Artificial Sequence: Synthetic polypeptide
KDRDEFPMILIGNKADLDHQRQVTQEEGQQLARQLKVTYM

SEQ ID NO: 3720 - protein, 40 aa, Artificial Sequence
  Description of Artificial Sequence: Synthetic polypeptide
DRDEFPMILIGNKADLDHQRQVTQEEGQQLARQLKVTYME

SEQ ID NO: 3721 - protein, 40 aa, Artificial Sequence
  Description of Artificial Sequence: Synthetic polypeptide
FPMILIGNKADLDHQRQVTQEEGQQLARQLKVTYMEASAK

SEQ ID NO: 3722 - protein, 40 aa, Artificial Sequence
  Description of Artificial Sequence: Synthetic polypeptide
PMILIGNKADLDHQRQVTQEEGQQLARQLKVTYMEASAKI

SEQ ID NO: 3723 - protein, 40 aa, Artificial Sequence
  Description of Artificial Sequence: Synthetic polypeptide
MILIGNKADLDHQRQVTQEEGQQLARQLKVTYMEASAKIR

SEQ ID NO: 3724 - protein, 40 aa, Artificial Sequence
  Description of Artificial Sequence: Synthetic polypeptide
LIGNKADLDHQRQVTQEEGQQLARQLKVTYMEASAKIRMN

SEQ ID NO: 3725 - protein, 40 aa, Artificial Sequence
  Description of Artificial Sequence: Synthetic polypeptide
IGNKADLDHQRQVTQEEGQQLARQLKVTYMEASAKIRMNV

SEQ ID NO: 3726 - protein, 40 aa, Artificial Sequence
  Description of Artificial Sequence: Synthetic polypeptide
ISALAIAALAEAATPYGIESFDSVLKPLWKGIRQHRGKGL

SEQ ID NO: 3727 - protein, 40 aa, Artificial Sequence
  Description of Artificial Sequence: Synthetic polypeptide
IESFDSVLKPLWKGIRQHRGKGLAAFLKAIGYLIPLMDAE

SEQ ID NO: 3728 - protein, 40 aa, Artificial Sequence
  Description of Artificial Sequence: Synthetic polypeptide
EYANYYTREVMLILIREFQSPDEEMKKIVLKVVKQCCGTD

SEQ ID NO: 3729 - protein, 40 aa, Artificial Sequence
  Description of Artificial Sequence: Synthetic polypeptide
VLPALMNEYRVPELNVQNGVLKSLSFLFEYIGEMGKDYIY

SEQ ID NO: 3730 - protein, 40 aa, Artificial Sequence
  Description of Artificial Sequence: Synthetic polypeptide
NEYRVPELNVQNGVLKSLSFLFEYIGEMGKDYIYAVTPLL

SEQ ID NO: 3731 - protein, 40 aa, Artificial Sequence
  Description of Artificial Sequence: Synthetic polypeptide
MLNYVWPNVFETSPHVIQAVMGALEGLRVAIGPCRMLQYC

SEQ ID NO: 3732 - protein, 40 aa, Artificial Sequence
  Description of Artificial Sequence: Synthetic polypeptide
SILPFTPPVVKRLLGWKKSAGGSGGAGGGEQNGQEEKWCE

SEQ ID NO: 3733 - protein, 40 aa, Artificial Sequence
  Description of Artificial Sequence: Synthetic polypeptide
EYRRQTVTSTPCWIELHLNGPLQWLDKVLTQMGSPSVRCS

SEQ ID NO: 3734 - protein, 40 aa, Artificial Sequence
  Description of Artificial Sequence: Synthetic polypeptide
LKHVKYCQYAFDLKCDSVCVNPYHYERVVSPGIDLSGLTL

SEQ ID NO: 3735 - protein, 40 aa, Artificial Sequence
  Description of Artificial Sequence: Synthetic polypeptide
KHVKYCQYAFDLKCDSVCVNPYHYERVVSPGIDLSGLTLQ

SEQ ID NO: 3736 - protein, 40 aa, Artificial Sequence
  Description of Artificial Sequence: Synthetic polypeptide
HVKYCQYAFDLKCDSVCVNPYHYERVVSPGIDLSGLTLQS

SEQ ID NO: 3737 - protein, 40 aa, Artificial Sequence
  Description of Artificial Sequence: Synthetic polypeptide
QYAFDLKCDSVCVNPYHYERVVSPGIDLSGLTLQSNAPSS

SEQ ID NO: 3738 - protein, 40 aa, Artificial Sequence
  Description of Artificial Sequence: Synthetic polypeptide
YAFDLKCDSVCVNPYHYERVVSPGIDLSGLTLQSNAPSSM

SEQ ID NO: 3739 - protein, 40 aa, Artificial Sequence
  Description of Artificial Sequence: Synthetic polypeptide
PVHNELAFQPPISNHPAPEYWCSIAYFEMDVQVGETFKVP

SEQ ID NO: 3740 - protein, 40 aa, Artificial Sequence
  Description of Artificial Sequence: Synthetic polypeptide
VHNELAFQPPISNHPAPEYWCSIAYFEMDVQVGETFKVPS

SEQ ID NO: 3741 - protein, 40 aa, Artificial Sequence
  Description of Artificial Sequence: Synthetic polypeptide
LAFQPPISNHPAPEYWCSIAYFEMDVQVGETFKVPSSCPI

SEQ ID NO: 3742 - protein, 40 aa, Artificial Sequence
  Description of Artificial Sequence: Synthetic polypeptide
AFQPPISNHPAPEYWCSIAYFEMDVQVGETFKVPSSCPIV

SEQ ID NO: 3743 - protein, 40 aa, Artificial Sequence
  Description of Artificial Sequence: Synthetic polypeptide
FQPPISNHPAPEYWCSIAYFEMDVQVGETFKVPSSCPIVT

SEQ ID NO: 3744 - protein, 40 aa, Artificial Sequence
  Description of Artificial Sequence: Synthetic polypeptide
VFVQSYYLDREAGRAPGDAVHKIYPSAYIKVFDLRQCHRQ

SEQ ID NO: 3745 - protein, 40 aa, Artificial Sequence
  Description of Artificial Sequence: Synthetic polypeptide
PGDAVHKIYPSAYIKVFDLRQCHRQMQQQAATAQAAAAAQ

SEQ ID NO: 3746 - protein, 40 aa, Artificial Sequence
  Description of Artificial Sequence: Synthetic polypeptide
VCHDPKLPYHDFILEDAASPKCIMKEKKKPGETFFMCSCS

SEQ ID NO: 3747 - protein, 40 aa, Artificial Sequence
  Description of Artificial Sequence: Synthetic polypeptide
DPKLPYHDFILEDAASPKCIMKEKKKPGETFFMCSCSSDE

SEQ ID NO: 3748 - protein, 40 aa, Artificial Sequence
  Description of Artificial Sequence: Synthetic polypeptide
PKLPYHDFILEDAASPKCIMKEKKKPGETFFMCSCSSDEC

SEQ ID NO: 3749 - protein, 40 aa, Artificial Sequence
  Description of Artificial Sequence: Synthetic polypeptide
KLPYHDFILEDAASPKCIMKEKKKPGETFFMCSCSSDECN

SEQ ID NO: 3750 - protein, 40 aa, Artificial Sequence
  Description of Artificial Sequence: Synthetic polypeptide
QNPGPRHPEAASAAPPGASLLLLQQQQQQQQQQQQQQQQQ

SEQ ID NO: 3751 - protein, 40 aa, Artificial Sequence
  Description of Artificial Sequence: Synthetic polypeptide
YTRPPQGLAGQESDFTAPDVWYPGGMVSRVPYPSPTCVKS

SEQ ID NO: 3752 - protein, 40 aa, Artificial Sequence
  Description of Artificial Sequence: Synthetic polypeptide
GSCKVFFKRAAEGKQKYLCASRNDCTIDKFRRKNCPSCRL

SEQ ID NO: 3753 - protein, 40 aa, Artificial Sequence
  Description of Artificial Sequence: Synthetic polypeptide
AGMTLGARKLKKLGNLKLQEEGEASSTTSPTEETTQKLTV

SEQ ID NO: 3754 - protein, 40 aa, Artificial Sequence
  Description of Artificial Sequence: Synthetic polypeptide
MTLGARKLKKLGNLKLQEEGEASSTTSPTEETTQKLTVSH

SEQ ID NO: 3755 - protein, 40 aa, Artificial Sequence
  Description of Artificial Sequence: Synthetic polypeptide
TLGARKLKKLGNLKLQEEGEASSTTSPTEETTQKLTVSHI

SEQ ID NO: 3756 - protein, 40 aa, Artificial Sequence
  Description of Artificial Sequence: Synthetic polypeptide
ALLLFSIIPVDGLKNQKFFDELRMNYIKELDRIIACKRKN

SEQ ID NO: 3757 - protein, 40 aa, Artificial Sequence
  Description of Artificial Sequence: Synthetic polypeptide
MKNQKFFDELRMNYIKELDRIIACKRKNPTSCSRRFYQLT

SEQ ID NO: 3758 - protein, 40 aa, Artificial Sequence
  Description of Artificial Sequence: Synthetic polypeptide
KNQKFFDELRMNYIKELDRIIACKRKNPTSCSRRFYQLTK

SEQ ID NO: 3759 - protein, 40 aa, Artificial Sequence
  Description of Artificial Sequence: Synthetic polypeptide
NQKFFDELRMNYIKELDRIIACKRKNPTSCSRRFYQLTKL

SEQ ID NO: 3760 - protein, 40 aa, Artificial Sequence
  Description of Artificial Sequence: Synthetic polypeptide
AALSGGGGGGAEPGQALFNGDMEPEAGAGAGAAASSAADP

SEQ ID NO: 3761 - protein, 40 aa, Artificial Sequence
  Description of Artificial Sequence: Synthetic polypeptide
GGGGGGAEPGQALFNGDMEPEAGAGAGAAASSAADPAIPE

SEQ ID NO: 3762 - protein, 40 aa, Artificial Sequence
  Description of Artificial Sequence: Synthetic polypeptide
GDMEPEAGAGAGAAASSAADPAIPEEVWNIKQMIKLTQEH

SEQ ID NO: 3763 - protein, 40 aa, Artificial Sequence
  Description of Artificial Sequence: Synthetic polypeptide
ESLGNGTDFSVSSSASMDTVTSSSSSSLSVLPSSLSVFQN

SEQ ID NO: 3764 - protein, 40 aa, Artificial Sequence
  Description of Artificial Sequence: Synthetic polypeptide
SLGNGTDFSVSSSASMDTVTSSSSSSLSVLPSSLSVFQNP

SEQ ID NO: 3765 - protein, 40 aa, Artificial Sequence
  Description of Artificial Sequence: Synthetic polypeptide
GNGTDFSVSSSASMDTVTSSSSSSLSVLPSSLSVFQNPTD

SEQ ID NO: 3766 - protein, 40 aa, Artificial Sequence
  Description of Artificial Sequence: Synthetic polypeptide
DFSVSSSASMDTVTSSSSSSLSVLPSSLSVFQNPTDVARS

SEQ ID NO: 3767 - protein, 40 aa, Artificial Sequence
  Description of Artificial Sequence: Synthetic polypeptide
TSSSSSSLSVLPSSLSVFQNPTDVARSNPKSPQKPIVRVF

SEQ ID NO: 3768 - protein, 40 aa, Artificial Sequence
  Description of Artificial Sequence: Synthetic polypeptide
NVPLTTHNFVRKTFFTLAFCDFCRKLLFQGFRCQTCGYKF

SEQ ID NO: 3769 - protein, 40 aa, Artificial Sequence
  Description of Artificial Sequence: Synthetic polypeptide
PLTTHNFVRKTFFTLAFCDFCRKLLFQGFRCQTCGYKFHQ

SEQ ID NO: 3770 - protein, 40 aa, Artificial Sequence
  Description of Artificial Sequence: Synthetic polypeptide
THNFVRKTFFTLAFCDFCRKLLFQGFRCQTCGYKFHQRCS

SEQ ID NO: 3771 - protein, 40 aa, Artificial Sequence
  Description of Artificial Sequence: Synthetic polypeptide
HNFVRKTFFTLAFCDFCRKLLFQGFRCQTCGYKFHQRCST

SEQ ID NO: 3772 - protein, 40 aa, Artificial Sequence
  Description of Artificial Sequence: Synthetic polypeptide
NFVRKTFFTLAFCDFCRKLLFQGFRCQTCGYKFHQRCSTE

SEQ ID NO: 3773 - protein, 40 aa, Artificial Sequence
  Description of Artificial Sequence: Synthetic polypeptide
VRKTFFTLAFCDFCRKLLFQGFRCQTCGYKFHQRCSTEVP

SEQ ID NO: 3774 - protein, 40 aa, Artificial Sequence
  Description of Artificial Sequence: Synthetic polypeptide
RKTFFTLAFCDFCRKLLFQGFRCQTCGYKFHQRCSTEVPL

SEQ ID NO: 3775 - protein, 40 aa, Artificial Sequence
  Description of Artificial Sequence: Synthetic polypeptide
TLAFCDFCRKLLFQGFRCQTCGYKFHQRCSTEVPLMCVNY

SEQ ID NO: 3776 - protein, 40 aa, Artificial Sequence
  Description of Artificial Sequence: Synthetic polypeptide
LAFCDFCRKLLFQGFRCQTCGYKFHQRCSTEVPLMCVNYD

SEQ ID NO: 3777 - protein, 40 aa, Artificial Sequence
  Description of Artificial Sequence: Synthetic polypeptide
FCDFCRKLLFQGFRCQTCGYKFHQRCSTEVPLMCVNYDQL

SEQ ID NO: 3778 - protein, 40 aa, Artificial Sequence
  Description of Artificial Sequence: Synthetic polypeptide
QTCGYKFHQRCSTEVPLMCVNYDQLDLLFVSKFFEHHPIP

SEQ ID NO: 3779 - protein, 40 aa, Artificial Sequence
  Description of Artificial Sequence: Synthetic polypeptide
PVNIDDLIRDQGFRGDGGSTTGLSATPPASLPGSLTNVKA

SEQ ID NO: 3780 - protein, 40 aa, Artificial Sequence
  Description of Artificial Sequence: Synthetic polypeptide
VNIDDLIRDQGFRGDGGSTTGLSATPPASLPGSLTNVKAL

SEQ ID NO: 3781 - protein, 40 aa, Artificial Sequence
  Description of Artificial Sequence: Synthetic polypeptide
IDDLIRDQGFRGDGGSTTGLSATPPASLPGSLTNVKALQK

SEQ ID NO: 3782 - protein, 40 aa, Artificial Sequence
  Description of Artificial Sequence: Synthetic polypeptide
DDLIRDQGFRGDGGSTTGLSATPPASLPGSLTNVKALQKS

SEQ ID NO: 3783 - protein, 40 aa, Artificial Sequence
  Description of Artificial Sequence: Synthetic polypeptide
DLIRDQGFRGDGGSTTGLSATPPASLPGSLTNVKALQKSP

SEQ ID NO: 3784 - protein, 40 aa, Artificial Sequence
  Description of Artificial Sequence: Synthetic polypeptide
MIRDQGFRGDGGSTTGLSATPPASLPGSLTNVKALQKSPG

SEQ ID NO: 3785 - protein, 40 aa, Artificial Sequence
  Description of Artificial Sequence: Synthetic polypeptide
IRDQGFRGDGGSTTGLSATPPASLPGSLTNVKALQKSPGP

SEQ ID NO: 3786 - protein, 40 aa, Artificial Sequence
  Description of Artificial Sequence: Synthetic polypeptide
GFRGDGGSTTGLSATPPASLPGSLTNVKALQKSPGPQRER

SEQ ID NO: 3787 - protein, 40 aa, Artificial Sequence
  Description of Artificial Sequence: Synthetic polypeptide
SLPGSLTNVKALQKSPGPQRERKSSSSSEDRNRMKTLGRR

SEQ ID NO: 3788 - protein, 40 aa, Artificial Sequence
  Description of Artificial Sequence: Synthetic polypeptide
ELMTGQLPYSNINNRDQIIFMVGRGYLSPDLSKVRSNCPK

SEQ ID NO: 3789 - protein, 40 aa, Artificial Sequence
  Description of Artificial Sequence: Synthetic polypeptide
GQLPYSNINNRDQIIFMVGRGYLSPDLSKVRSNCPKAMKR

SEQ ID NO: 3790 - protein, 40 aa, Artificial Sequence
  Description of Artificial Sequence: Synthetic polypeptide
PYSNINNRDQIIFMVGRGYLSPDLSKVRSNCPKAMKRLMA

SEQ ID NO: 3791 - protein, 40 aa, Artificial Sequence
  Description of Artificial Sequence: Synthetic polypeptide
NNRDQIIFMVGRGYLSPDLSKVRSNCPKAMKRLMAECLKK

SEQ ID NO: 3792 - protein, 40 aa, Artificial Sequence
  Description of Artificial Sequence: Synthetic polypeptide
RDQIIFMVGRGYLSPDLSKVRSNCPKAMKRLMAECLKKKR

SEQ ID NO: 3793 - protein, 40 aa, Artificial Sequence
  Description of Artificial Sequence: Synthetic polypeptide
SLKFLSLDYIPQRKQEPIKDALMLFQRLQEKRMLEESNLS

SEQ ID NO: 3794 - protein, 40 aa, Artificial Sequence
  Description of Artificial Sequence: Synthetic polypeptide
QEKRMLEESNLSFLKELLFRINRLDLLITYLNTRKEEMER

SEQ ID NO: 3795 - protein, 40 aa, Artificial Sequence
  Description of Artificial Sequence: Synthetic polypeptide
IEMEKRVILGEGKLDILKRVCAQINKSLLKIINDYEEFSK

SEQ ID NO: 3796 - protein, 40 aa, Artificial Sequence
  Description of Artificial Sequence: Synthetic polypeptide
EGKLDILKRVCAQINKSLLKIINDYEEFSKERSSSLEGSP

SEQ ID NO: 3797 - protein, 40 aa, Artificial Sequence
  Description of Artificial Sequence: Synthetic polypeptide
MDILKRVCAQINKSLLKIINDYEEFSKERSSSLEGSPDEF

SEQ ID NO: 3798 - protein, 40 aa, Artificial Sequence
  Description of Artificial Sequence: Synthetic polypeptide
MKRVCAQINKSLLKIINDYEEFSKERSSSLEGSPDEFSNG

SEQ ID NO: 3799 - protein, 40 aa, Artificial Sequence
  Description of Artificial Sequence: Synthetic polypeptide
MKCPSLAGKPKVFFIQACQGDNYQKGIPVETDSEEQPYLE

SEQ ID NO: 3800 - protein, 40 aa, Artificial Sequence
  Description of Artificial Sequence: Synthetic polypeptide
CPRGDDILTILTEVNYEVSNKDDKKNMGKQMPQPTFTLRK

SEQ ID NO: 3801 - protein, 40 aa, Artificial Sequence
  Description of Artificial Sequence: Synthetic polypeptide
PRGDDILTILTEVNYEVSNKDDKKNMGKQMPQPTFTLRKK

SEQ ID NO: 3802 - protein, 40 aa, Artificial Sequence
  Description of Artificial Sequence: Synthetic polypeptide
RGDDILTILTEVNYEVSNKDDKKNMGKQMPQPTFTLRKKL

SEQ ID NO: 3803 - protein, 40 aa, Artificial Sequence
  Description of Artificial Sequence: Synthetic polypeptide
GDDILTILTEVNYEVSNKDDKKNMGKQMPQPTFTLRKKLV

SEQ ID NO: 3804 - protein, 40 aa, Artificial Sequence
  Description of Artificial Sequence: Synthetic polypeptide
DDILTILTEVNYEVSNKDDKKNMGKQMPQPTFTLRKKLVF

SEQ ID NO: 3805 - protein, 40 aa, Artificial Sequence
  Description of Artificial Sequence: Synthetic polypeptide
RRQKRDWVIPPISCPENEKGPFPKNLVQIKSNKDKEGKVF

SEQ ID NO: 3806 - protein, 40 aa, Artificial Sequence
  Description of Artificial Sequence: Synthetic polypeptide
RQKRDWVIPPISCPENEKGPFPKNLVQIKSNKDKEGKVFY

SEQ ID NO: 3807 - protein, 40 aa, Artificial Sequence
  Description of Artificial Sequence: Synthetic polypeptide
QKRDWVIPPISCPENEKGPFPKNLVQIKSNKDKEGKVFYS

SEQ ID NO: 3808 - protein, 40 aa, Artificial Sequence
  Description of Artificial Sequence: Synthetic polypeptide
NEKGPFPKNLVQIKSNKDKEGKVFYSITGQGADTPPVGVF

SEQ ID NO: 3809 - protein, 40 aa, Artificial Sequence
  Description of Artificial Sequence: Synthetic polypeptide
ISVVTTGLDRESFPTYTLVVQAADLQGEGLSTTATAVITV

SEQ ID NO: 3810 - protein, 40 aa, Artificial Sequence
  Description of Artificial Sequence: Synthetic polypeptide
SVVTTGLDRESFPTYTLVVQAADLQGEGLSTTATAVITVT

SEQ ID NO: 3811 - protein, 40 aa, Artificial Sequence
  Description of Artificial Sequence: Synthetic polypeptide
DRESFPTYTLVVQAADLQGEGLSTTATAVITVTDTNDNPP

SEQ ID NO: 3812 - protein, 40 aa, Artificial Sequence
  Description of Artificial Sequence: Synthetic polypeptide
TYTLVVQAADLQGEGLSTTATAVITVTDTNDNPPIFNPTT

SEQ ID NO: 3813 - protein, 40 aa, Artificial Sequence
  Description of Artificial Sequence: Synthetic polypeptide
FTAELTHGASANWTIQYNDPTQESIILKPKMALEVGDYKI

SEQ ID NO: 3814 - protein, 40 aa, Artificial Sequence
  Description of Artificial Sequence: Synthetic polypeptide
HGASANWTIQYNDPTQESIILKPKMALEVGDYKINLKLMD

SEQ ID NO: 3815 - protein, 40 aa, Artificial Sequence
  Description of Artificial Sequence: Synthetic polypeptide
ANWTIQYNDPTQESIILKPKMALEVGDYKINLKLMDNQNK

SEQ ID NO: 3816 - protein, 40 aa, Artificial Sequence
  Description of Artificial Sequence: Synthetic polypeptide
QESIILKPKMALEVGDYKINLKLMDNQNKDQVTTLEVSVC

SEQ ID NO: 3817 - protein, 40 aa, Artificial Sequence
  Description of Artificial Sequence: Synthetic polypeptide
GTLSSLETVSTQELYSIPEDQEPEDQEPEEPTPAPWARLW

SEQ ID NO: 3818 - protein, 40 aa, Artificial Sequence
  Description of Artificial Sequence: Synthetic polypeptide
SSLETVSTQELYSIPEDQEPEDQEPEEPTPAPWARLWALQ

SEQ ID NO: 3819 - protein, 40 aa, Artificial Sequence
  Description of Artificial Sequence: Synthetic polypeptide
ETVSTQELYSIPEDQEPEDQEPEEPTPAPWARLWALQDGF

SEQ ID NO: 3820 - protein, 40 aa, Artificial Sequence
  Description of Artificial Sequence: Synthetic polypeptide
ALQDGFANLECVNDNYWFGRDKSCEYCFDEPLLKRTDKYR

SEQ ID NO: 3821 - protein, 40 aa, Artificial Sequence
  Description of Artificial Sequence: Synthetic polypeptide
KKHFRIFREVGPKNSYIAYIEDHSGNGTFVNTELVGKGKR

SEQ ID NO: 3822 - protein, 40 aa, Artificial Sequence
  Description of Artificial Sequence: Synthetic polypeptide
FRIFREVGPKNSYIAYIEDHSGNGTFVNTELVGKGKRRPL

SEQ ID NO: 3823 - protein, 40 aa, Artificial Sequence
  Description of Artificial Sequence: Synthetic polypeptide
REVGPKNSYIAYIEDHSGNGTFVNTELVGKGKRRPLNNNS

SEQ ID NO: 3824 - protein, 40 aa, Artificial Sequence
  Description of Artificial Sequence: Synthetic polypeptide
GPKNSYIAYIEDHSGNGTFVNTELVGKGKRRPLNNNSEIA

SEQ ID NO: 3825 - protein, 40 aa, Artificial Sequence
  Description of Artificial Sequence: Synthetic polypeptide
PKNSYIAYIEDHSGNGTFVNTELVGKGKRRPLNNNSEIAL

SEQ ID NO: 3826 - protein, 40 aa, Artificial Sequence
  Description of Artificial Sequence: Synthetic polypeptide
EDHSGNGTFVNTELVGKGKRRPLNNNSEIALSLSRNKVFV

SEQ ID NO: 3827 - protein, 40 aa, Artificial Sequence
  Description of Artificial Sequence: Synthetic polypeptide
DHSGNGTFVNTELVGKGKRRPLNNNSEIALSLSRNKVFVF

SEQ ID NO: 3828 - protein, 40 aa, Artificial Sequence
  Description of Artificial Sequence: Synthetic polypeptide
SGNGTFVNTELVGKGKRRPLNNNSEIALSLSRNKVFVFFD

SEQ ID NO: 3829 - protein, 40 aa, Artificial Sequence
  Description of Artificial Sequence: Synthetic polypeptide
GNGTFVNTELVGKGKRRPLNNNSEIALSLSRNKVFVFFDL

SEQ ID NO: 3830 - protein, 40 aa, Artificial Sequence
  Description of Artificial Sequence: Synthetic polypeptide
NGTFVNTELVGKGKRRPLNNNSEIALSLSRNKVFVFFDLT

SEQ ID NO: 3831 - protein, 40 aa, Artificial Sequence
  Description of Artificial Sequence: Synthetic polypeptide
VNTELVGKGKRRPLNNNSEIALSLSRNKVFVFFDLTVDDQ

SEQ ID NO: 3832 - protein, 40 aa, Artificial Sequence
  Description of Artificial Sequence: Synthetic polypeptide
KGKRRPLNNNSEIALSLSRNKVFVFFDLTVDDQSVYPKAL

SEQ ID NO: 3833 - protein, 40 aa, Artificial Sequence
  Description of Artificial Sequence: Synthetic polypeptide
RKTCKKVAIKIISKRKFAIGSAREADPALNVETEIEILKK

SEQ ID NO: 3834 - protein, 40 aa, Artificial Sequence
  Description of Artificial Sequence: Synthetic polypeptide
KTCKKVAIKIISKRKFAIGSAREADPALNVETEIEILKKL

SEQ ID NO: 3835 - protein, 40 aa, Artificial Sequence
  Description of Artificial Sequence: Synthetic polypeptide
TCKKVAIKIISKRKFAIGSAREADPALNVETEIEILKKLN

SEQ ID NO: 3836 - protein, 40 aa, Artificial Sequence
  Description of Artificial Sequence: Synthetic polypeptide
CKKVAIKIISKRKFAIGSAREADPALNVETEIEILKKLNH

SEQ ID NO: 3837 - protein, 40 aa, Artificial Sequence
  Description of Artificial Sequence: Synthetic polypeptide
SKRKFAIGSAREADPALNVETEIEILKKLNHPCIIKIKNF

SEQ ID NO: 3838 - protein, 40 aa, Artificial Sequence
  Description of Artificial Sequence: Synthetic polypeptide
SAREADPALNVETEIEILKKLNHPCIIKIKNFFDAEDYYI

SEQ ID NO: 3839 - protein, 40 aa, Artificial Sequence
  Description of Artificial Sequence: Synthetic polypeptide
READPALNVETEIEILKKLNHPCIIKIKNFFDAEDYYIVL

SEQ ID NO: 3840 - protein, 40 aa, Artificial Sequence
  Description of Artificial Sequence: Synthetic polypeptide
ADPALNVETEIEILKKLNHPCIIKIKNFFDAEDYYIVLEL

SEQ ID NO: 3841 - protein, 40 aa, Artificial Sequence
  Description of Artificial Sequence: Synthetic polypeptide
DPALNVETEIEILKKLNHPCIIKIKNFFDAEDYYIVLELM

SEQ ID NO: 3842 - protein, 40 aa, Artificial Sequence
  Description of Artificial Sequence: Synthetic polypeptide
ALNVETEIEILKKLNHPCIIKIKNFFDAEDYYIVLELMEG

SEQ ID NO: 3843 - protein, 40 aa, Artificial Sequence
  Description of Artificial Sequence: Synthetic polypeptide
ETEIEILKKLNHPCIIKIKNFFDAEDYYIVLELMEGGELF

SEQ ID NO: 3844 - protein, 40 aa, Artificial Sequence
  Description of Artificial Sequence: Synthetic polypeptide
KNFFDAEDYYIVLELMEGGELFDKVVGNKRLKEATCKLYF

SEQ ID NO: 3845 - protein, 40 aa, Artificial Sequence
  Description of Artificial Sequence: Synthetic polypeptide
SLMRTLCGTPTYLAPEVLVSVGTAGYNRAVDCWSLGVILF

SEQ ID NO: 3846 - protein, 40 aa, Artificial Sequence
  Description of Artificial Sequence: Synthetic polypeptide
LMRTLCGTPTYLAPEVLVSVGTAGYNRAVDCWSLGVILFI

SEQ ID NO: 3847 - protein, 40 aa, Artificial Sequence
  Description of Artificial Sequence: Synthetic polypeptide
RTLCGTPTYLAPEVLVSVGTAGYNRAVDCWSLGVILFICL

SEQ ID NO: 3848 - protein, 40 aa, Artificial Sequence
  Description of Artificial Sequence: Synthetic polypeptide
LCGTPTYLAPEVLVSVGTAGYNRAVDCWSLGVILFICLSG

SEQ ID NO: 3849 - protein, 40 aa, Artificial Sequence
  Description of Artificial Sequence: Synthetic polypeptide
CGTPTYLAPEVLVSVGTAGYNRAVDCWSLGVILFICLSGY

SEQ ID NO: 3850 - protein, 40 aa, Artificial Sequence
  Description of Artificial Sequence: Synthetic polypeptide
TPTYLAPEVLVSVGTAGYNRAVDCWSLGVILFICLSGYPP

SEQ ID NO: 3851 - protein, 40 aa, Artificial Sequence
  Description of Artificial Sequence: Synthetic polypeptide
PTYLAPEVLVSVGTAGYNRAVDCWSLGVILFICLSGYPPF

SEQ ID NO: 3852 - protein, 40 aa, Artificial Sequence
  Description of Artificial Sequence: Synthetic polypeptide
TYLAPEVLVSVGTAGYNRAVDCWSLGVILFICLSGYPPFS

SEQ ID NO: 3853 - protein, 40 aa, Artificial Sequence
  Description of Artificial Sequence: Synthetic polypeptide
YLAPEVLVSVGTAGYNRAVDCWSLGVILFICLSGYPPFSE

SEQ ID NO: 3854 - protein, 40 aa, Artificial Sequence
  Description of Artificial Sequence: Synthetic polypeptide
MAPEVLVSVGTAGYNRAVDCWSLGVILFICLSGYPPFSEH

SEQ ID NO: 3855 - protein, 40 aa, Artificial Sequence
  Description of Artificial Sequence: Synthetic polypeptide
PEVLVSVGTAGYNRAVDCWSLGVILFICLSGYPPFSEHRT

SEQ ID NO: 3856 - protein, 40 aa, Artificial Sequence
  Description of Artificial Sequence: Synthetic polypeptide
LVSVGTAGYNRAVDCWSLGVILFICLSGYPPFSEHRTQVS

SEQ ID NO: 3857 - protein, 40 aa, Artificial Sequence
  Description of Artificial Sequence: Synthetic polypeptide
GTAGYNRAVDCWSLGVILFICLSGYPPFSEHRTQVSLKDQ

SEQ ID NO: 3858 - protein, 40 aa, Artificial Sequence
  Description of Artificial Sequence: Synthetic polypeptide
DLLSEENESTALPQVLAQPSTSRKRPREGEAEGAETTKRP

SEQ ID NO: 3859 - protein, 40 aa, Artificial Sequence
  Description of Artificial Sequence: Synthetic polypeptide
LLSEENESTALPQVLAQPSTSRKRPREGEAEGAETTKRPA

SEQ ID NO: 3860 - protein, 40 aa, Artificial Sequence
  Description of Artificial Sequence: Synthetic polypeptide
ILAYGNQESKLIILASGGPQALVNIMRTYTYEKLLWTTSR

SEQ ID NO: 3861 - protein, 40 aa, Artificial Sequence
  Description of Artificial Sequence: Synthetic polypeptide
NHAPLREQGAIPRLVQLLVRAHQDTQRRTSMGGTQQQFVE

SEQ ID NO: 3862 - protein, 40 aa, Artificial Sequence
  Description of Artificial Sequence: Synthetic polypeptide
HAPLREQGAIPRLVQLLVRAHQDTQRRTSMGGTQQQFVEG

SEQ ID NO: 3863 - protein, 40 aa, Artificial Sequence
  Description of Artificial Sequence: Synthetic polypeptide
ENALGLDQQFAGLDLNSSDNQSGGSTASKGRYIPPHLRNR

SEQ ID NO: 3864 - protein, 40 aa, Artificial Sequence
  Description of Artificial Sequence: Synthetic polypeptide
IPPHLRNREATKGFYDKDSSGWSSSKDKDAYSSFGSRSDS

SEQ ID NO: 3865 - protein, 40 aa, Artificial Sequence
  Description of Artificial Sequence: Synthetic polypeptide
AQTGSGKTAAFLLPILSQIYSDGPGEALRAMKENGRYGRR

SEQ ID NO: 3866 - protein, 40 aa, Artificial Sequence
  Description of Artificial Sequence: Synthetic polypeptide
QTGSGKTAAFLLPILSQIYSDGPGEALRAMKENGRYGRRK

SEQ ID NO: 3867 - protein, 40 aa, Artificial Sequence
  Description of Artificial Sequence: Synthetic polypeptide
GSGKTAAFLLPILSQIYSDGPGEALRAMKENGRYGRRKQY

SEQ ID NO: 3868 - protein, 40 aa, Artificial Sequence
  Description of Artificial Sequence: Synthetic polypeptide
SGKTAAFLLPILSQIYSDGPGEALRAMKENGRYGRRKQYP

SEQ ID NO: 3869 - protein, 40 aa, Artificial Sequence
  Description of Artificial Sequence: Synthetic polypeptide
KTAAFLLPILSQIYSDGPGEALRAMKENGRYGRRKQYPIS

SEQ ID NO: 3870 - protein, 40 aa, Artificial Sequence
  Description of Artificial Sequence: Synthetic polypeptide
SQIYSDGPGEALRAMKENGRYGRRKQYPISLVLAPTRELA

SEQ ID NO: 3871 - protein, 40 aa, Artificial Sequence
  Description of Artificial Sequence: Synthetic polypeptide
QIYSDGPGEALRAMKENGRYGRRKQYPISLVLAPTRELAV

SEQ ID NO: 3872 - protein, 40 aa, Artificial Sequence
  Description of Artificial Sequence: Synthetic polypeptide
IYSDGPGEALRAMKENGRYGRRKQYPISLVLAPTRELAVQ

SEQ ID NO: 3873 - protein, 40 aa, Artificial Sequence
  Description of Artificial Sequence: Synthetic polypeptide
YSDGPGEALRAMKENGRYGRRKQYPISLVLAPTRELAVQI

SEQ ID NO: 3874 - protein, 40 aa, Artificial Sequence
  Description of Artificial Sequence: Synthetic polypeptide
EALRAMKENGRYGRRKQYPISLVLAPTRELAVQIYEEARK

SEQ ID NO: 3875 - protein, 40 aa, Artificial Sequence
  Description of Artificial Sequence: Synthetic polypeptide
FEPQIRRIVEQDTMPPKGVRHTMMFSATFPKEIQMLARDF

SEQ ID NO: 3876 - protein, 40 aa, Artificial Sequence
  Description of Artificial Sequence: Synthetic polypeptide
RHTMMFSATFPKEIQMLARDFLDEYIFLAVGRVGSTSENI

SEQ ID NO: 3877 - protein, 40 aa, Artificial Sequence
  Description of Artificial Sequence: Synthetic polypeptide
LDEYIFLAVGRVGSTSENITQKVVWVEESDKRSFLLDLLN

SEQ ID NO: 3878 - protein, 40 aa, Artificial Sequence
  Description of Artificial Sequence: Synthetic polypeptide
MAVGRVGSTSENITQKVVWVEESDKRSFLLDLLNATGKDS

SEQ ID NO: 3879 - protein, 40 aa, Artificial Sequence
  Description of Artificial Sequence: Synthetic polypeptide
QVLIMTCYVALNVLKNGYLSLSDINLLVFDECHLAILDHP

SEQ ID NO: 3880 - protein, 40 aa, Artificial Sequence
  Description of Artificial Sequence: Synthetic polypeptide
TASILNGKCDPEELEEKIQKLEKILKSNAETATDLVVLDR

SEQ ID NO: 3881 - protein, 40 aa, Artificial Sequence
  Description of Artificial Sequence: Synthetic polypeptide
QPCEIVVDCGPFTDRSGLYERLLMELEEALNFINDCNISV

SEQ ID NO: 3882 - protein, 40 aa, Artificial Sequence
  Description of Artificial Sequence: Synthetic polypeptide
VVDCGPFTDRSGLYERLLMELEEALNFINDCNISVHSKER

SEQ ID NO: 3883 - protein, 40 aa, Artificial Sequence
  Description of Artificial Sequence: Synthetic polypeptide
CGPFTDRSGLYERLLMELEEALNFINDCNISVHSKERDST

SEQ ID NO: 3884 - protein, 40 aa, Artificial Sequence
  Description of Artificial Sequence: Synthetic polypeptide
GPFTDRSGLYERLLMELEEALNFINDCNISVHSKERDSTL

SEQ ID NO: 3885 - protein, 40 aa, Artificial Sequence
  Description of Artificial Sequence: Synthetic polypeptide
PFTDRSGLYERLLMELEEALNFINDCNISVHSKERDSTLI

SEQ ID NO: 3886 - protein, 40 aa, Artificial Sequence
  Description of Artificial Sequence: Synthetic polypeptide
SGLYERLLMELEEALNFINDCNISVHSKERDSTLISKQIL

SEQ ID NO: 3887 - protein, 40 aa, Artificial Sequence
  Description of Artificial Sequence: Synthetic polypeptide
ELEEALNFINDCNISVHSKERDSTLISKQILSDCRAVLVV

SEQ ID NO: 3888 - protein, 40 aa, Artificial Sequence
  Description of Artificial Sequence: Synthetic polypeptide
LEEALNFINDCNISVHSKERDSTLISKQILSDCRAVLVVL

SEQ ID NO: 3889 - protein, 40 aa, Artificial Sequence
  Description of Artificial Sequence: Synthetic polypeptide
ALNFINDCNISVHSKERDSTLISKQILSDCRAVLVVLGPW

SEQ ID NO: 3890 - protein, 40 aa, Artificial Sequence
  Description of Artificial Sequence: Synthetic polypeptide
LNFINDCNISVHSKERDSTLISKQILSDCRAVLVVLGPWC

SEQ ID NO: 3891 - protein, 40 aa, Artificial Sequence
  Description of Artificial Sequence: Synthetic polypeptide
NFINDCNISVHSKERDSTLISKQILSDCRAVLVVLGPWCA

SEQ ID NO: 3892 - protein, 40 aa, Artificial Sequence
  Description of Artificial Sequence: Synthetic polypeptide
NDCNISVHSKERDSTLISKQILSDCRAVLVVLGPWCADKV

SEQ ID NO: 3893 - protein, 40 aa, Artificial Sequence
  Description of Artificial Sequence: Synthetic polypeptide
HSKERDSTLISKQILSDCRAVLVVLGPWCADKVAGMMVRE

SEQ ID NO: 3894 - protein, 40 aa, Artificial Sequence
  Description of Artificial Sequence: Synthetic polypeptide
ERDSTLISKQILSDCRAVLVVLGPWCADKVAGMMVRELQK

SEQ ID NO: 3895 - protein, 40 aa, Artificial Sequence
  Description of Artificial Sequence: Synthetic polypeptide
LSDCRAVLVVLGPWCADKVAGMMVRELQKYIKHEQEELHR

SEQ ID NO: 3896 - protein, 40 aa, Artificial Sequence
  Description of Artificial Sequence: Synthetic polypeptide
AVLVVLGPWCADKVAGMMVRELQKYIKHEQEELHRKFLLF

SEQ ID NO: 3897 - protein, 40 aa, Artificial Sequence
  Description of Artificial Sequence: Synthetic polypeptide
GPWCADKVAGMMVRELQKYIKHEQEELHRKFLLFTDTFLR

SEQ ID NO: 3898 - protein, 40 aa, Artificial Sequence
  Description of Artificial Sequence: Synthetic polypeptide
SLDLKFVTPKVIKLLEILRKYKPYERQQFESVEWYNNRNQ

SEQ ID NO: 3899 - protein, 40 aa, Artificial Sequence
  Description of Artificial Sequence: Synthetic polypeptide
DLKFVTPKVIKLLEILRKYKPYERQQFESVEWYNNRNQDN

SEQ ID NO: 3900 - protein, 40 aa, Artificial Sequence
  Description of Artificial Sequence: Synthetic polypeptide
MKFVTPKVIKLLEILRKYKPYERQQFESVEWYNNRNQDNY

SEQ ID NO: 3901 - protein, 40 aa, Artificial Sequence
  Description of Artificial Sequence: Synthetic polypeptide
KVIKLLEILRKYKPYERQQFESVEWYNNRNQDNYVSWSDS

SEQ ID NO: 3902 - protein, 40 aa, Artificial Sequence
  Description of Artificial Sequence: Synthetic polypeptide
MLEILRKYKPYERQQFESVEWYNNRNQDNYVSWSDSEDDD

SEQ ID NO: 3903 - protein, 40 aa, Artificial Sequence
  Description of Artificial Sequence: Synthetic polypeptide
LEILRKYKPYERQQFESVEWYNNRNQDNYVSWSDSEDDDE

SEQ ID NO: 3904 - protein, 40 aa, Artificial Sequence
  Description of Artificial Sequence: Synthetic polypeptide
PYERQQFESVEWYNNRNQDNYVSWSDSEDDDEDEEIEEKE

SEQ ID NO: 3905 - protein, 40 aa, Artificial Sequence
  Description of Artificial Sequence: Synthetic polypeptide
ERQQFESVEWYNNRNQDNYVSWSDSEDDDEDEEIEEKEKP

SEQ ID NO: 3906 - protein, 40 aa, Artificial Sequence
  Description of Artificial Sequence: Synthetic polypeptide
WYNNRNQDNYVSWSDSEDDDEDEEIEEKEKPETNFPSPFT

SEQ ID NO: 3907 - protein, 40 aa, Artificial Sequence
  Description of Artificial Sequence: Synthetic polypeptide
AVVLNRLIKEAGKQDPELAYISSNFITGHGIGKNQPRNKQ

SEQ ID NO: 3908 - protein, 40 aa, Artificial Sequence
  Description of Artificial Sequence: Synthetic polypeptide
EGVDIPKCNLVVRFDLPTEYRSYVQSKGRARAPISNYIML

SEQ ID NO: 3909 - protein, 40 aa, Artificial Sequence
  Description of Artificial Sequence: Synthetic polypeptide
MVVRFDLPTEYRSYVQSKGRARAPISNYIMLADTDKIKSF

SEQ ID NO: 3910 - protein, 40 aa, Artificial Sequence
  Description of Artificial Sequence: Synthetic polypeptide
VVRFDLPTEYRSYVQSKGRARAPISNYIMLADTDKIKSFE

SEQ ID NO: 3911 - protein, 40 aa, Artificial Sequence
  Description of Artificial Sequence: Synthetic polypeptide
VRFDLPTEYRSYVQSKGRARAPISNYIMLADTDKIKSFEE

SEQ ID NO: 3912 - protein, 40 aa, Artificial Sequence
  Description of Artificial Sequence: Synthetic polypeptide
RFDLPTEYRSYVQSKGRARAPISNYIMLADTDKIKSFEED

SEQ ID NO: 3913 - protein, 40 aa, Artificial Sequence
  Description of Artificial Sequence: Synthetic polypeptide
FDLPTEYRSYVQSKGRARAPISNYIMLADTDKIKSFEEDL

SEQ ID NO: 3914 - protein, 40 aa, Artificial Sequence
  Description of Artificial Sequence: Synthetic polypeptide
DLPTEYRSYVQSKGRARAPISNYIMLADTDKIKSFEEDLK

SEQ ID NO: 3915 - protein, 40 aa, Artificial Sequence
  Description of Artificial Sequence: Synthetic polypeptide
MPTEYRSYVQSKGRARAPISNYIMLADTDKIKSFEEDLKT

SEQ ID NO: 3916 - protein, 40 aa, Artificial Sequence
  Description of Artificial Sequence: Synthetic polypeptide
TEYRSYVQSKGRARAPISNYIMLADTDKIKSFEEDLKTYK

SEQ ID NO: 3917 - protein, 40 aa, Artificial Sequence
  Description of Artificial Sequence: Synthetic polypeptide
RSYVQSKGRARAPISNYIMLADTDKIKSFEEDLKTYKAIE

SEQ ID NO: 3918 - protein, 40 aa, Artificial Sequence
  Description of Artificial Sequence: Synthetic polypeptide
IMLADTDKIKSFEEDLKTYKAIEKILRNKCSKSVDTGETD

SEQ ID NO: 3919 - protein, 40 aa, Artificial Sequence
  Description of Artificial Sequence: Synthetic polypeptide
MLADTDKIKSFEEDLKTYKAIEKILRNKCSKSVDTGETDI

SEQ ID NO: 3920 - protein, 40 aa, Artificial Sequence
  Description of Artificial Sequence: Synthetic polypeptide
LADTDKIKSFEEDLKTYKAIEKILRNKCSKSVDTGETDID

SEQ ID NO: 3921 - protein, 40 aa, Artificial Sequence
  Description of Artificial Sequence: Synthetic polypeptide
DTDKIKSFEEDLKTYKAIEKILRNKCSKSVDTGETDIDPV

SEQ ID NO: 3922 - protein, 40 aa, Artificial Sequence
  Description of Artificial Sequence: Synthetic polypeptide
KIKSFEEDLKTYKAIEKILRNKCSKSVDTGETDIDPVMDD

SEQ ID NO: 3923 - protein, 40 aa, Artificial Sequence
  Description of Artificial Sequence: Synthetic polypeptide
IGELDDHLMPVGKETVKYEEELDLHDEEETSVPGRPGSTK

SEQ ID NO: 3924 - protein, 40 aa, Artificial Sequence
  Description of Artificial Sequence: Synthetic polypeptide
ELDDHLMPVGKETVKYEEELDLHDEEETSVPGRPGSTKRR

SEQ ID NO: 3925 - protein, 40 aa, Artificial Sequence
  Description of Artificial Sequence: Synthetic polypeptide
FPVYTRSGEVTISIELKKSGFMLSLQMLELITRLHQYIFS

SEQ ID NO: 3926 - protein, 40 aa, Artificial Sequence
  Description of Artificial Sequence: Synthetic polypeptide
VYTRSGEVTISIELKKSGFMLSLQMLELITRLHQYIFSHI

SEQ ID NO: 3927 - protein, 40 aa, Artificial Sequence
  Description of Artificial Sequence: Synthetic polypeptide
KSGFMLSLQMLELITRLHQYIFSHILRLEKPALEFKPTDA

SEQ ID NO: 3928 - protein, 40 aa, Artificial Sequence
  Description of Artificial Sequence: Synthetic polypeptide
DIDFKFMEDIEKSEARIGIPSTKYTKETPFVFKLEDYQDA

SEQ ID NO: 3929 - protein, 40 aa, Artificial Sequence
  Description of Artificial Sequence: Synthetic polypeptide
DFKFMEDIEKSEARIGIPSTKYTKETPFVFKLEDYQDAVI

SEQ ID NO: 3930 - protein, 40 aa, Artificial Sequence
  Description of Artificial Sequence: Synthetic polypeptide
KFMEDIEKSEARIGIPSTKYTKETPFVFKLEDYQDAVIIP

SEQ ID NO: 3931 - protein, 40 aa, Artificial Sequence
  Description of Artificial Sequence: Synthetic polypeptide
MSVNCRTLLSESPGKLHVEVSADLTAINGLSYNQNLANGS

SEQ ID NO: 3932 - protein, 40 aa, Artificial Sequence
  Description of Artificial Sequence: Synthetic polypeptide
GDSFLKHAITTYLFCTYPDAHEGRLSYMRSKKVSNCNLYR

SEQ ID NO: 3933 - protein, 40 aa, Artificial Sequence
  Description of Artificial Sequence: Synthetic polypeptide
FLKHAITTYLFCTYPDAHEGRLSYMRSKKVSNCNLYRLGK

SEQ ID NO: 3934 - protein, 40 aa, Artificial Sequence
  Description of Artificial Sequence: Synthetic polypeptide
APKEEADYEDDFLEYDQEHIRFIDNMLMGSGAFVKKISLS

SEQ ID NO: 3935 - protein, 40 aa, Artificial Sequence
  Description of Artificial Sequence: Synthetic polypeptide
DYEDDFLEYDQEHIRFIDNMLMGSGAFVKKISLSPFSTTD

SEQ ID NO: 3936 - protein, 40 aa, Artificial Sequence
  Description of Artificial Sequence: Synthetic polypeptide
EDDFLEYDQEHIRFIDNMLMGSGAFVKKISLSPFSTTDSA

SEQ ID NO: 3937 - protein, 40 aa, Artificial Sequence
  Description of Artificial Sequence: Synthetic polypeptide
DQEHIRFIDNMLMGSGAFVKKISLSPFSTTDSAYEWKMPK

SEQ ID NO: 3938 - protein, 40 aa, Artificial Sequence
  Description of Artificial Sequence: Synthetic polypeptide
IRFIDNMLMGSGAFVKKISLSPFSTTDSAYEWKMPKKSSL

SEQ ID NO: 3939 - protein, 40 aa, Artificial Sequence
  Description of Artificial Sequence: Synthetic polypeptide
RFIDNMLMGSGAFVKKISLSPFSTTDSAYEWKMPKKSSLG

SEQ ID NO: 3940 - protein, 40 aa, Artificial Sequence
  Description of Artificial Sequence: Synthetic polypeptide
SIADCVEALLGCYLTSCGERAAQLFLCSLGLKVLPVIKRT

SEQ ID NO: 3941 - protein, 40 aa, Artificial Sequence
  Description of Artificial Sequence: Synthetic polypeptide
IADCVEALLGCYLTSCGERAAQLFLCSLGLKVLPVIKRTD

SEQ ID NO: 3942 - protein, 40 aa, Artificial Sequence
  Description of Artificial Sequence: Synthetic polypeptide
ALLALLAALCPASRALEEKKVCQGTSNKLTQLGTFEDHFL

SEQ ID NO: 3943 - protein, 40 aa, Artificial Sequence
  Description of Artificial Sequence: Synthetic polypeptide
LNTVERIPLENLQIIRGNMYYENSYALAVLSNYDANKTGL

SEQ ID NO: 3944 - protein, 40 aa, Artificial Sequence
  Description of Artificial Sequence: Synthetic polypeptide
MEEDGVRKCKKCEGPCRKVCNGIGIGEFKDSLSINATNIK

SEQ ID NO: 3945 - protein, 40 aa, Artificial Sequence
  Description of Artificial Sequence: Synthetic polypeptide
AFRGDSFTHTPPLDPQELDILKTVKEITGFLLIQAWPENR

SEQ ID NO: 3946 - protein, 40 aa, Artificial Sequence
  Description of Artificial Sequence: Synthetic polypeptide
QHGQFSLAVVSLNITSLGLRSLKEISDGDVIISGNKNLCY

SEQ ID NO: 3947 - protein, 40 aa, Artificial Sequence
  Description of Artificial Sequence: Synthetic polypeptide
SLKEISDGDVIISGNKNLCYANTINWKKLFGTSGQKTKII

SEQ ID NO: 3948 - protein, 40 aa, Artificial Sequence
  Description of Artificial Sequence: Synthetic polypeptide
LKEISDGDVIISGNKNLCYANTINWKKLFGTSGQKTKIIS

SEQ ID NO: 3949 - protein, 40 aa, Artificial Sequence
  Description of Artificial Sequence: Synthetic polypeptide
ISDGDVIISGNKNLCYANTINWKKLFGTSGQKTKIISNRG

SEQ ID NO: 3950 - protein, 40 aa, Artificial Sequence
  Description of Artificial Sequence: Synthetic polypeptide
SDGDVIISGNKNLCYANTINWKKLFGTSGQKTKIISNRGE

SEQ ID NO: 3951 - protein, 40 aa, Artificial Sequence
  Description of Artificial Sequence: Synthetic polypeptide
DGDVIISGNKNLCYANTINWKKLFGTSGQKTKIISNRGEN

SEQ ID NO: 3952 - protein, 40 aa, Artificial Sequence
  Description of Artificial Sequence: Synthetic polypeptide
GDVIISGNKNLCYANTINWKKLFGTSGQKTKIISNRGENS

SEQ ID NO: 3953 - protein, 40 aa, Artificial Sequence
  Description of Artificial Sequence: Synthetic polypeptide
DVIISGNKNLCYANTINWKKLFGTSGQKTKIISNRGENSC

SEQ ID NO: 3954 - protein, 40 aa, Artificial Sequence
  Description of Artificial Sequence: Synthetic polypeptide
VIISGNKNLCYANTINWKKLFGTSGQKTKIISNRGENSCK

SEQ ID NO: 3955 - protein, 40 aa, Artificial Sequence
  Description of Artificial Sequence: Synthetic polypeptide
IISGNKNLCYANTINWKKLFGTSGQKTKIISNRGENSCKA

SEQ ID NO: 3956 - protein, 40 aa, Artificial Sequence
  Description of Artificial Sequence: Synthetic polypeptide
GNKNLCYANTINWKKLFGTSGQKTKIISNRGENSCKATGQ

SEQ ID NO: 3957 - protein, 40 aa, Artificial Sequence
  Description of Artificial Sequence: Synthetic polypeptide
NKNLCYANTINWKKLFGTSGQKTKIISNRGENSCKATGQV

SEQ ID NO: 3958 - protein, 40 aa, Artificial Sequence
  Description of Artificial Sequence: Synthetic polypeptide
KNLCYANTINWKKLFGTSGQKTKIISNRGENSCKATGQVC

SEQ ID NO: 3959 - protein, 40 aa, Artificial Sequence
  Description of Artificial Sequence: Synthetic polypeptide
NLCYANTINWKKLFGTSGQKTKIISNRGENSCKATGQVCH

SEQ ID NO: 3960 - protein, 40 aa, Artificial Sequence
  Description of Artificial Sequence: Synthetic polypeptide
YANTINWKKLFGTSGQKTKIISNRGENSCKATGQVCHALC

SEQ ID NO: 3961 - protein, 40 aa, Artificial Sequence
  Description of Artificial Sequence: Synthetic polypeptide
ANTINWKKLFGTSGQKTKIISNRGENSCKATGQVCHALCS

SEQ ID NO: 3962 - protein, 40 aa, Artificial Sequence
  Description of Artificial Sequence: Synthetic polypeptide
NTINWKKLFGTSGQKTKIISNRGENSCKATGQVCHALCSP

SEQ ID NO: 3963 - protein, 40 aa, Artificial Sequence
  Description of Artificial Sequence: Synthetic polypeptide
EAPNQALLRILKETEFKKIKVLGSGAFGTVYKGLWIPEGE

SEQ ID NO: 3964 - protein, 40 aa, Artificial Sequence
  Description of Artificial Sequence: Synthetic polypeptide
APNQALLRILKETEFKKIKVLGSGAFGTVYKGLWIPEGEK

SEQ ID NO: 3965 - protein, 40 aa, Artificial Sequence
  Description of Artificial Sequence: Synthetic polypeptide
PNQALLRILKETEFKKIKVLGSGAFGTVYKGLWIPEGEKV

SEQ ID NO: 3966 - protein, 40 aa, Artificial Sequence
  Description of Artificial Sequence: Synthetic polypeptide
NQALLRILKETEFKKIKVLGSGAFGTVYKGLWIPEGEKVK

SEQ ID NO: 3967 - protein, 40 aa, Artificial Sequence
  Description of Artificial Sequence: Synthetic polypeptide
QALLRILKETEFKKIKVLGSGAFGTVYKGLWIPEGEKVKI

SEQ ID NO: 3968 - protein, 40 aa, Artificial Sequence
  Description of Artificial Sequence: Synthetic polypeptide
RILKETEFKKIKVLGSGAFGTVYKGLWIPEGEKVKIPVAI

SEQ ID NO: 3969 - protein, 40 aa, Artificial Sequence
  Description of Artificial Sequence: Synthetic polypeptide
MKETEFKKIKVLGSGAFGTVYKGLWIPEGEKVKIPVAIKE

SEQ ID NO: 3970 - protein, 40 aa, Artificial Sequence
  Description of Artificial Sequence: Synthetic polypeptide
KETEFKKIKVLGSGAFGTVYKGLWIPEGEKVKIPVAIKEL

SEQ ID NO: 3971 - protein, 40 aa, Artificial Sequence
  Description of Artificial Sequence: Synthetic polypeptide
ETEFKKIKVLGSGAFGTVYKGLWIPEGEKVKIPVAIKELR

SEQ ID NO: 3972 - protein, 40 aa, Artificial Sequence
  Description of Artificial Sequence: Synthetic polypeptide
EFKKIKVLGSGAFGTVYKGLWIPEGEKVKIPVAIKELREA

SEQ ID NO: 3973 - protein, 40 aa, Artificial Sequence
  Description of Artificial Sequence: Synthetic polypeptide
KVLGSGAFGTVYKGLWIPEGEKVKIPVAIKELREATSPKA

SEQ ID NO: 3974 - protein, 40 aa, Artificial Sequence
  Description of Artificial Sequence: Synthetic polypeptide
QLFEDNYALAVLDNGDPLNNTTPVTGASPGGLRELQLRSL

SEQ ID NO: 3975 - protein, 40 aa, Artificial Sequence
  Description of Artificial Sequence: Synthetic polypeptide
DNYALAVLDNGDPLNNTTPVTGASPGGLRELQLRSLTEIL

SEQ ID NO: 3976 - protein, 40 aa, Artificial Sequence
  Description of Artificial Sequence: Synthetic polypeptide
NYALAVLDNGDPLNNTTPVTGASPGGLRELQLRSLTEILK

SEQ ID NO: 3977 - protein, 40 aa, Artificial Sequence
  Description of Artificial Sequence: Synthetic polypeptide
AVLDNGDPLNNTTPVTGASPGGLRELQLRSLTEILKGGVL

SEQ ID NO: 3978 - protein, 40 aa, Artificial Sequence
  Description of Artificial Sequence: Synthetic polypeptide
VLDNGDPLNNTTPVTGASPGGLRELQLRSLTEILKGGVLI

SEQ ID NO: 3979 - protein, 40 aa, Artificial Sequence
  Description of Artificial Sequence: Synthetic polypeptide
DNGDPLNNTTPVTGASPGGLRELQLRSLTEILKGGVLIQR

SEQ ID NO: 3980 - protein, 40 aa, Artificial Sequence
  Description of Artificial Sequence: Synthetic polypeptide
NGDPLNNTTPVTGASPGGLRELQLRSLTEILKGGVLIQRN

SEQ ID NO: 3981 - protein, 40 aa, Artificial Sequence
  Description of Artificial Sequence: Synthetic polypeptide
DPLNNTTPVTGASPGGLRELQLRSLTEILKGGVLIQRNPQ

SEQ ID NO: 3982 - protein, 40 aa, Artificial Sequence
  Description of Artificial Sequence: Synthetic polypeptide
NQEVTAEDGTQRCEKCSKPCARVCYGLGMEHLREVRAVTS

SEQ ID NO: 3983 - protein, 40 aa, Artificial Sequence
  Description of Artificial Sequence: Synthetic polypeptide
RILHNGAYSLTLQGLGISWLGLRSLRELGSGLALIHHNTH

SEQ ID NO: 3984 - protein, 40 aa, Artificial Sequence
  Description of Artificial Sequence: Synthetic polypeptide
KYTMRRLLQETELVEPLTPSGAMPNQAQMRILKETELRKV

SEQ ID NO: 3985 - protein, 40 aa, Artificial Sequence
  Description of Artificial Sequence: Synthetic polypeptide
RRLLQETELVEPLTPSGAMPNQAQMRILKETELRKVKVLG

SEQ ID NO: 3986 - protein, 40 aa, Artificial Sequence
  Description of Artificial Sequence: Synthetic polypeptide
PHMHNFSVFSNLTTIGGRSLYNRGFSLLIMKNLNVTSLGF

SEQ ID NO: 3987 - protein, 40 aa, Artificial Sequence
  Description of Artificial Sequence: Synthetic polypeptide
NFSVFSNLTTIGGRSLYNRGFSLLIMKNLNVTSLGFRSLK

SEQ ID NO: 3988 - protein, 40 aa, Artificial Sequence
  Description of Artificial Sequence: Synthetic polypeptide
VFSNLTTIGGRSLYNRGFSLLIMKNLNVTSLGFRSLKEIS

SEQ ID NO: 3989 - protein, 40 aa, Artificial Sequence
  Description of Artificial Sequence: Synthetic polypeptide
VVIFMMLGGTFLYWRGRRIQNKRAMRRYLERGESIEPLDP

SEQ ID NO: 3990 - protein, 40 aa, Artificial Sequence
  Description of Artificial Sequence: Synthetic polypeptide
MMLGGTFLYWRGRRIQNKRAMRRYLERGESIEPLDPSEKA

SEQ ID NO: 3991 - protein, 40 aa, Artificial Sequence
  Description of Artificial Sequence: Synthetic polypeptide
VIKRESGPGIAPGPEPHGLTNKKLEEVELEPELDLDLDLE

SEQ ID NO: 3992 - protein, 40 aa, Artificial Sequence
  Description of Artificial Sequence: Synthetic polypeptide
RDGGGPGGDYAAMGACPASEQGYEEMRAFQGPGHQAPHVH

SEQ ID NO: 3993 - protein, 40 aa, Artificial Sequence
  Description of Artificial Sequence: Synthetic polypeptide
PGGDYAAMGACPASEQGYEEMRAFQGPGHQAPHVHYARLK

SEQ ID NO: 3994 - protein, 40 aa, Artificial Sequence
  Description of Artificial Sequence: Synthetic polypeptide
GGDYAAMGACPASEQGYEEMRAFQGPGHQAPHVHYARLKT

SEQ ID NO: 3995 - protein, 40 aa, Artificial Sequence
  Description of Artificial Sequence: Synthetic polypeptide
AAMGACPASEQGYEEMRAFQGPGHQAPHVHYARLKTLRSL

SEQ ID NO: 3996 - protein, 40 aa, Artificial Sequence
  Description of Artificial Sequence: Synthetic polypeptide
SEQGYEEMRAFQGPGHQAPHVHYARLKTLRSLEATDSAFD

SEQ ID NO: 3997 - protein, 40 aa, Artificial Sequence
  Description of Artificial Sequence: Synthetic polypeptide
EQGYEEMRAFQGPGHQAPHVHYARLKTLRSLEATDSAFDN

SEQ ID NO: 3998 - protein, 40 aa, Artificial Sequence
  Description of Artificial Sequence: Synthetic polypeptide
QGYEEMRAFQGPGHQAPHVHYARLKTLRSLEATDSAFDNP

SEQ ID NO: 3999 - protein, 40 aa, Artificial Sequence
  Description of Artificial Sequence: Synthetic polypeptide
TVQPSDSQSVCAGTENKLSSLSDLEQQYRALRKYYENCEV

SEQ ID NO: 4000 - protein, 40 aa, Artificial Sequence
  Description of Artificial Sequence: Synthetic polypeptide
VLVALNQFRYLPLENLRIIRGTKLYEDRYALAIFLNYRKD

SEQ ID NO: 4001 - protein, 40 aa, Artificial Sequence
  Description of Artificial Sequence: Synthetic polypeptide
LVALNQFRYLPLENLRIIRGTKLYEDRYALAIFLNYRKDG

SEQ ID NO: 4002 - protein, 40 aa, Artificial Sequence
  Description of Artificial Sequence: Synthetic polypeptide
ALNQFRYLPLENLRIIRGTKLYEDRYALAIFLNYRKDGNF

SEQ ID NO: 4003 - protein, 40 aa, Artificial Sequence
  Description of Artificial Sequence: Synthetic polypeptide
ENLRIIRGTKLYEDRYALAIFLNYRKDGNFGLQELGLKNL

SEQ ID NO: 4004 - protein, 40 aa, Artificial Sequence
  Description of Artificial Sequence: Synthetic polypeptide
NLRIIRGTKLYEDRYALAIFLNYRKDGNFGLQELGLKNLT

SEQ ID NO: 4005 - protein, 40 aa, Artificial Sequence
  Description of Artificial Sequence: Synthetic polypeptide
RIIRGTKLYEDRYALAIFLNYRKDGNFGLQELGLKNLTEI

SEQ ID NO: 4006 - protein, 40 aa, Artificial Sequence
  Description of Artificial Sequence: Synthetic polypeptide
IIRGTKLYEDRYALAIFLNYRKDGNFGLQELGLKNLTEIL

SEQ ID NO: 4007 - protein, 40 aa, Artificial Sequence
  Description of Artificial Sequence: Synthetic polypeptide
IRGTKLYEDRYALAIFLNYRKDGNFGLQELGLKNLTEILN

SEQ ID NO: 4008 - protein, 40 aa, Artificial Sequence
  Description of Artificial Sequence: Synthetic polypeptide
RGTKLYEDRYALAIFLNYRKDGNFGLQELGLKNLTEILNG

SEQ ID NO: 4009 - protein, 40 aa, Artificial Sequence
  Description of Artificial Sequence: Synthetic polypeptide
GTKLYEDRYALAIFLNYRKDGNFGLQELGLKNLTEILNGG

SEQ ID NO: 4010 - protein, 40 aa, Artificial Sequence
  Description of Artificial Sequence: Synthetic polypeptide
KLYEDRYALAIFLNYRKDGNFGLQELGLKNLTEILNGGVY

SEQ ID NO: 4011 - protein, 40 aa, Artificial Sequence
  Description of Artificial Sequence: Synthetic polypeptide
LYEDRYALAIFLNYRKDGNFGLQELGLKNLTEILNGGVYV

SEQ ID NO: 4012 - protein, 40 aa, Artificial Sequence
  Description of Artificial Sequence: Synthetic polypeptide
YEDRYALAIFLNYRKDGNFGLQELGLKNLTEILNGGVYVD

SEQ ID NO: 4013 - protein, 40 aa, Artificial Sequence
  Description of Artificial Sequence: Synthetic polypeptide
EDRYALAIFLNYRKDGNFGLQELGLKNLTEILNGGVYVDQ

SEQ ID NO: 4014 - protein, 40 aa, Artificial Sequence
  Description of Artificial Sequence: Synthetic polypeptide
DRYALAIFLNYRKDGNFGLQELGLKNLTEILNGGVYVDQN

SEQ ID NO: 4015 - protein, 40 aa, Artificial Sequence
  Description of Artificial Sequence: Synthetic polypeptide
YALAIFLNYRKDGNFGLQELGLKNLTEILNGGVYVDQNKF

SEQ ID NO: 4016 - protein, 40 aa, Artificial Sequence
  Description of Artificial Sequence: Synthetic polypeptide
AIFLNYRKDGNFGLQELGLKNLTEILNGGVYVDQNKFLCY

SEQ ID NO: 4017 - protein, 40 aa, Artificial Sequence
  Description of Artificial Sequence: Synthetic polypeptide
IFLNYRKDGNFGLQELGLKNLTEILNGGVYVDQNKFLCYA

SEQ ID NO: 4018 - protein, 40 aa, Artificial Sequence
  Description of Artificial Sequence: Synthetic polypeptide
FLNYRKDGNFGLQELGLKNLTEILNGGVYVDQNKFLCYAD

SEQ ID NO: 4019 - protein, 40 aa, Artificial Sequence
  Description of Artificial Sequence: Synthetic polypeptide
NYRKDGNFGLQELGLKNLTEILNGGVYVDQNKFLCYADTI

SEQ ID NO: 4020 - protein, 40 aa, Artificial Sequence
  Description of Artificial Sequence: Synthetic polypeptide
QHARTPLIAAGVIGGLFILVIVGLTFAVYVRRKSIKKKRA

SEQ ID NO: 4021 - protein, 40 aa, Artificial Sequence
  Description of Artificial Sequence: Synthetic polypeptide
ARTPLIAAGVIGGLFILVIVGLTFAVYVRRKSIKKKRALR

SEQ ID NO: 4022 - protein, 40 aa, Artificial Sequence
  Description of Artificial Sequence: Synthetic polypeptide
RTPLIAAGVIGGLFILVIVGLTFAVYVRRKSIKKKRALRR

SEQ ID NO: 4023 - protein, 40 aa, Artificial Sequence
  Description of Artificial Sequence: Synthetic polypeptide
TPLIAAGVIGGLFILVIVGLTFAVYVRRKSIKKKRALRRF

SEQ ID NO: 4024 - protein, 40 aa, Artificial Sequence
  Description of Artificial Sequence: Synthetic polypeptide
PLIAAGVIGGLFILVIVGLTFAVYVRRKSIKKKRALRRFL

SEQ ID NO: 4025 - protein, 40 aa, Artificial Sequence
  Description of Artificial Sequence: Synthetic polypeptide
IAAGVIGGLFILVIVGLTFAVYVRRKSIKKKRALRRFLET

SEQ ID NO: 4026 - protein, 40 aa, Artificial Sequence
  Description of Artificial Sequence: Synthetic polypeptide
GVIGGLFILVIVGLTFAVYVRRKSIKKKRALRRFLETELV

SEQ ID NO: 4027 - protein, 40 aa, Artificial Sequence
  Description of Artificial Sequence: Synthetic polypeptide
VIGGLFILVIVGLTFAVYVRRKSIKKKRALRRFLETELVE

SEQ ID NO: 4028 - protein, 40 aa, Artificial Sequence
  Description of Artificial Sequence: Synthetic polypeptide
VIVGLTFAVYVRRKSIKKKRALRRFLETELVEPLTPSGTA

SEQ ID NO: 4029 - protein, 40 aa, Artificial Sequence
  Description of Artificial Sequence: Synthetic polypeptide
VGLTFAVYVRRKSIKKKRALRRFLETELVEPLTPSGTAPN

SEQ ID NO: 4030 - protein, 40 aa, Artificial Sequence
  Description of Artificial Sequence: Synthetic polypeptide
IKKKRALRRFLETELVEPLTPSGTAPNQAQLRILKETELK

SEQ ID NO: 4031 - protein, 40 aa, Artificial Sequence
  Description of Artificial Sequence: Synthetic polypeptide
KKKRALRRFLETELVEPLTPSGTAPNQAQLRILKETELKR

SEQ ID NO: 4032 - protein, 40 aa, Artificial Sequence
  Description of Artificial Sequence: Synthetic polypeptide
KKRALRRFLETELVEPLTPSGTAPNQAQLRILKETELKRV

SEQ ID NO: 4033 - protein, 40 aa, Artificial Sequence
  Description of Artificial Sequence: Synthetic polypeptide
KRALRRFLETELVEPLTPSGTAPNQAQLRILKETELKRVK

SEQ ID NO: 4034 - protein, 40 aa, Artificial Sequence
  Description of Artificial Sequence: Synthetic polypeptide
LTPSGTAPNQAQLRILKETELKRVKVLGSGAFGTVYKGIW

SEQ ID NO: 4035 - protein, 40 aa, Artificial Sequence
  Description of Artificial Sequence: Synthetic polypeptide
APNQAQLRILKETELKRVKVLGSGAFGTVYKGIWVPEGET

SEQ ID NO: 4036 - protein, 40 aa, Artificial Sequence
  Description of Artificial Sequence: Synthetic polypeptide
NQAQLRILKETELKRVKVLGSGAFGTVYKGIWVPEGETVK

SEQ ID NO: 4037 - protein, 40 aa, Artificial Sequence
  Description of Artificial Sequence: Synthetic polypeptide
QAQLRILKETELKRVKVLGSGAFGTVYKGIWVPEGETVKI

SEQ ID NO: 4038 - protein, 40 aa, Artificial Sequence
  Description of Artificial Sequence: Synthetic polypeptide
QLRILKETELKRVKVLGSGAFGTVYKGIWVPEGETVKIPV

SEQ ID NO: 4039 - protein, 40 aa, Artificial Sequence
  Description of Artificial Sequence: Synthetic polypeptide
LRILKETELKRVKVLGSGAFGTVYKGIWVPEGETVKIPVA

SEQ ID NO: 4040 - protein, 40 aa, Artificial Sequence
  Description of Artificial Sequence: Synthetic polypeptide
ILKETELKRVKVLGSGAFGTVYKGIWVPEGETVKIPVAIK

SEQ ID NO: 4041 - protein, 40 aa, Artificial Sequence
  Description of Artificial Sequence: Synthetic polypeptide
MKETELKRVKVLGSGAFGTVYKGIWVPEGETVKIPVAIKI

SEQ ID NO: 4042 - protein, 40 aa, Artificial Sequence
  Description of Artificial Sequence: Synthetic polypeptide
ETELKRVKVLGSGAFGTVYKGIWVPEGETVKIPVAIKILN

SEQ ID NO: 4043 - protein, 40 aa, Artificial Sequence
  Description of Artificial Sequence: Synthetic polypeptide
TELKRVKVLGSGAFGTVYKGIWVPEGETVKIPVAIKILNE

SEQ ID NO: 4044 - protein, 40 aa, Artificial Sequence
  Description of Artificial Sequence: Synthetic polypeptide
MKRVKVLGSGAFGTVYKGIWVPEGETVKIPVAIKILNETT

SEQ ID NO: 4045 - protein, 40 aa, Artificial Sequence
  Description of Artificial Sequence: Synthetic polypeptide
VKVLGSGAFGTVYKGIWVPEGETVKIPVAIKILNETTGPK

SEQ ID NO: 4046 - protein, 40 aa, Artificial Sequence
  Description of Artificial Sequence: Synthetic polypeptide
VLGSGAFGTVYKGIWVPEGETVKIPVAIKILNETTGPKAN

SEQ ID NO: 4047 - protein, 40 aa, Artificial Sequence
  Description of Artificial Sequence: Synthetic polypeptide
SGAFGTVYKGIWVPEGETVKIPVAIKILNETTGPKANVEF

SEQ ID NO: 4048 - protein, 40 aa, Artificial Sequence
  Description of Artificial Sequence: Synthetic polypeptide
QLSSPFYTKTTKMKRKLDHGSEVRSFSLGKKPCKVSEYTS

SEQ ID NO: 4049 - protein, 40 aa, Artificial Sequence
  Description of Artificial Sequence: Synthetic polypeptide
SSPFYTKTTKMKRKLDHGSEVRSFSLGKKPCKVSEYTSTT

SEQ ID NO: 4050 - protein, 40 aa, Artificial Sequence
  Description of Artificial Sequence: Synthetic polypeptide
SPFYTKTTKMKRKLDHGSEVRSFSLGKKPCKVSEYTSTTG

SEQ ID NO: 4051 - protein, 40 aa, Artificial Sequence
  Description of Artificial Sequence: Synthetic polypeptide
PFYTKTTKMKRKLDHGSEVRSFSLGKKPCKVSEYTSTTGL

SEQ ID NO: 4052 - protein, 40 aa, Artificial Sequence
  Description of Artificial Sequence: Synthetic polypeptide
FYTKTTKMKRKLDHGSEVRSFSLGKKPCKVSEYTSTTGLV

SEQ ID NO: 4053 - protein, 40 aa, Artificial Sequence
  Description of Artificial Sequence: Synthetic polypeptide
YTKTTKMKRKLDHGSEVRSFSLGKKPCKVSEYTSTTGLVP

SEQ ID NO: 4054 - protein, 40 aa, Artificial Sequence
  Description of Artificial Sequence: Synthetic polypeptide
RYWRILAEDNLLWREKCKEEGIDEPLHIKRRKVIKPGFIH

SEQ ID NO: 4055 - protein, 40 aa, Artificial Sequence
  Description of Artificial Sequence: Synthetic polypeptide
EDNLLWREKCKEEGIDEPLHIKRRKVIKPGFIHSPWKSAY

SEQ ID NO: 4056 - protein, 40 aa, Artificial Sequence
  Description of Artificial Sequence: Synthetic polypeptide
NLLWREKCKEEGIDEPLHIKRRKVIKPGFIHSPWKSAYIR

SEQ ID NO: 4057 - protein, 40 aa, Artificial Sequence
  Description of Artificial Sequence: Synthetic polypeptide
EEGIDEPLHIKRRKVIKPGFIHSPWKSAYIRQHRIDTNWR

SEQ ID NO: 4058 - protein, 40 aa, Artificial Sequence
  Description of Artificial Sequence: Synthetic polypeptide
YDFMVKVWDPETETCLHTLQGHTNRVYSLQFDGIHVVSGS

SEQ ID NO: 4059 - protein, 40 aa, Artificial Sequence
  Description of Artificial Sequence: Synthetic polypeptide
DFMVKVWDPETETCLHTLQGHTNRVYSLQFDGIHVVSGSL

SEQ ID NO: 4060 - protein, 40 aa, Artificial Sequence
  Description of Artificial Sequence: Synthetic polypeptide
MQGHTNRVYSLQFDGIHVVSGSLDTSIRVWDVETGNCIHT

SEQ ID NO: 4061 - protein, 40 aa, Artificial Sequence
  Description of Artificial Sequence: Synthetic polypeptide
NRVYSLQFDGIHVVSGSLDTSIRVWDVETGNCIHTLTGHQ

SEQ ID NO: 4062 - protein, 40 aa, Artificial Sequence
  Description of Artificial Sequence: Synthetic polypeptide
AGGNPMPTMRWLKNGKEFKQEHRIGGYKVRNQHWSLIMES

SEQ ID NO: 4063 - protein, 40 aa, Artificial Sequence
  Description of Artificial Sequence: Synthetic polypeptide
GNPMPTMRWLKNGKEFKQEHRIGGYKVRNQHWSLIMESVV

SEQ ID NO: 4064 - protein, 40 aa, Artificial Sequence
  Description of Artificial Sequence: Synthetic polypeptide
RWLKNGKEFKQEHRIGGYKVRNQHWSLIMESVVPSDKGNY

SEQ ID NO: 4065 - protein, 40 aa, Artificial Sequence
  Description of Artificial Sequence: Synthetic polypeptide
WLKNGKEFKQEHRIGGYKVRNQHWSLIMESVVPSDKGNYT

SEQ ID NO: 4066 - protein, 40 aa, Artificial Sequence
  Description of Artificial Sequence: Synthetic polypeptide
NGKEFKQEHRIGGYKVRNQHWSLIMESVVPSDKGNYTCVV

SEQ ID NO: 4067 - protein, 40 aa, Artificial Sequence
  Description of Artificial Sequence: Synthetic polypeptide
EVLALFNVTEADAGEYICKVSNYIGQANQSAWLTVLPKQQ

SEQ ID NO: 4068 - protein, 40 aa, Artificial Sequence
  Description of Artificial Sequence: Synthetic polypeptide
NVTEADAGEYICKVSNYIGQANQSAWLTVLPKQQAPGREK

SEQ ID NO: 4069 - protein, 40 aa, Artificial Sequence
  Description of Artificial Sequence: Synthetic polypeptide
TEADAGEYICKVSNYIGQANQSAWLTVLPKQQAPGREKEI

SEQ ID NO: 4070 - protein, 40 aa, Artificial Sequence
  Description of Artificial Sequence: Synthetic polypeptide
EYICKVSNYIGQANQSAWLTVLPKQQAPGREKEITASPDY

SEQ ID NO: 4071 - protein, 40 aa, Artificial Sequence
  Description of Artificial Sequence: Synthetic polypeptide
YICKVSNYIGQANQSAWLTVLPKQQAPGREKEITASPDYL

SEQ ID NO: 4072 - protein, 40 aa, Artificial Sequence
  Description of Artificial Sequence: Synthetic polypeptide
ICKVSNYIGQANQSAWLTVLPKQQAPGREKEITASPDYLE

SEQ ID NO: 4073 - protein, 40 aa, Artificial Sequence
  Description of Artificial Sequence: Synthetic polypeptide
CRMKNTTKKPDFSSQPAVHKLTKRIPLRRQVTVSAESSSS

SEQ ID NO: 4074 - protein, 40 aa, Artificial Sequence
  Description of Artificial Sequence: Synthetic polypeptide
KDKPKEAVTVAVKMLKDDATEKDLSDLVSEMEMMKMIGKH

SEQ ID NO: 4075 - protein, 40 aa, Artificial Sequence
  Description of Artificial Sequence: Synthetic polypeptide
GKHKNIINLLGACTQDGPLYVIVEYASKGNLREYLRARRP

SEQ ID NO: 4076 - protein, 40 aa, Artificial Sequence
  Description of Artificial Sequence: Synthetic polypeptide
RGVVSMVILKMTETQAGEYLLFIQSEATNYTILFTVSIRN

SEQ ID NO: 4077 - protein, 40 aa, Artificial Sequence
  Description of Artificial Sequence: Synthetic polypeptide
VILKMTETQAGEYLLFIQSEATNYTILFTVSIRNTLLYTL

SEQ ID NO: 4078 - protein, 40 aa, Artificial Sequence
  Description of Artificial Sequence: Synthetic polypeptide
ILKMTETQAGEYLLFIQSEATNYTILFTVSIRNTLLYTLR

SEQ ID NO: 4079 - protein, 40 aa, Artificial Sequence
  Description of Artificial Sequence: Synthetic polypeptide
KMTETQAGEYLLFIQSEATNYTILFTVSIRNTLLYTLRRP

SEQ ID NO: 4080 - protein, 40 aa, Artificial Sequence
  Description of Artificial Sequence: Synthetic polypeptide
MTETQAGEYLLFIQSEATNYTILFTVSIRNTLLYTLRRPY

SEQ ID NO: 4081 - protein, 40 aa, Artificial Sequence
  Description of Artificial Sequence: Synthetic polypeptide
TETQAGEYLLFIQSEATNYTILFTVSIRNTLLYTLRRPYF

SEQ ID NO: 4082 - protein, 40 aa, Artificial Sequence
  Description of Artificial Sequence: Synthetic polypeptide
ETQAGEYLLFIQSEATNYTILFTVSIRNTLLYTLRRPYFR

SEQ ID NO: 4083 - protein, 40 aa, Artificial Sequence
  Description of Artificial Sequence: Synthetic polypeptide
TQAGEYLLFIQSEATNYTILFTVSIRNTLLYTLRRPYFRK

SEQ ID NO: 4084 - protein, 40 aa, Artificial Sequence
  Description of Artificial Sequence: Synthetic polypeptide
QAGEYLLFIQSEATNYTILFTVSIRNTLLYTLRRPYFRKM

SEQ ID NO: 4085 - protein, 40 aa, Artificial Sequence
  Description of Artificial Sequence: Synthetic polypeptide
LFIQSEATNYTILFTVSIRNTLLYTLRRPYFRKMENQDAL

SEQ ID NO: 4086 - protein, 40 aa, Artificial Sequence
  Description of Artificial Sequence: Synthetic polypeptide
RNTLLYTLRRPYFRKMENQDALVCISESVPEPIVEWVLCD

SEQ ID NO: 4087 - protein, 40 aa, Artificial Sequence
  Description of Artificial Sequence: Synthetic polypeptide
TLLYTLRRPYFRKMENQDALVCISESVPEPIVEWVLCDSQ

SEQ ID NO: 4088 - protein, 40 aa, Artificial Sequence
  Description of Artificial Sequence: Synthetic polypeptide
LYTLRRPYFRKMENQDALVCISESVPEPIVEWVLCDSQGE

SEQ ID NO: 4089 - protein, 40 aa, Artificial Sequence
  Description of Artificial Sequence: Synthetic polypeptide
TLRRPYFRKMENQDALVCISESVPEPIVEWVLCDSQGESC

SEQ ID NO: 4090 - protein, 40 aa, Artificial Sequence
  Description of Artificial Sequence: Synthetic polypeptide
YFRKMENQDALVCISESVPEPIVEWVLCDSQGESCKEESP

SEQ ID NO: 4091 - protein, 40 aa, Artificial Sequence
  Description of Artificial Sequence: Synthetic polypeptide
RKMENQDALVCISESVPEPIVEWVLCDSQGESCKEESPAV

SEQ ID NO: 4092 - protein, 40 aa, Artificial Sequence
  Description of Artificial Sequence: Synthetic polypeptide
ENQDALVCISESVPEPIVEWVLCDSQGESCKEESPAVVKK

SEQ ID NO: 4093 - protein, 40 aa, Artificial Sequence
  Description of Artificial Sequence: Synthetic polypeptide
ASASQASCFSDGYPLPSWTWKKCSDKSPNCTEEITEGVWN

SEQ ID NO: 4094 - protein, 40 aa, Artificial Sequence
  Description of Artificial Sequence: Synthetic polypeptide
LNSPGPFPFIQDNISFYATIGVCLLFIVVLTLLICHKYKK

SEQ ID NO: 4095 - protein, 40 aa, Artificial Sequence
  Description of Artificial Sequence: Synthetic polypeptide
FPFIQDNISFYATIGVCLLFIVVLTLLICHKYKKQFRYES

SEQ ID NO: 4096 - protein, 40 aa, Artificial Sequence
  Description of Artificial Sequence: Synthetic polypeptide
QFRYESQLQMVQVTGSSDNEYFYVDFREYEYDLKWEFPRE

SEQ ID NO: 4097 - protein, 40 aa, Artificial Sequence
  Description of Artificial Sequence: Synthetic polypeptide
LQMVQVTGSSDNEYFYVDFREYEYDLKWEFPRENLEFGKV

SEQ ID NO: 4098 - protein, 40 aa, Artificial Sequence
  Description of Artificial Sequence: Synthetic polypeptide
QMVQVTGSSDNEYFYVDFREYEYDLKWEFPRENLEFGKVL

SEQ ID NO: 4099 - protein, 40 aa, Artificial Sequence
  Description of Artificial Sequence: Synthetic polypeptide
YVDFREYEYDLKWEFPRENLEFGKVLGSGAFGKVMNATAY

SEQ ID NO: 4100 - protein, 40 aa, Artificial Sequence
  Description of Artificial Sequence: Synthetic polypeptide
VDFREYEYDLKWEFPRENLEFGKVLGSGAFGKVMNATAYG

SEQ ID NO: 4101 - protein, 40 aa, Artificial Sequence
  Description of Artificial Sequence: Synthetic polypeptide
REYEYDLKWEFPRENLEFGKVLGSGAFGKVMNATAYGISK

SEQ ID NO: 4102 - protein, 40 aa, Artificial Sequence
  Description of Artificial Sequence: Synthetic polypeptide
EYEYDLKWEFPRENLEFGKVLGSGAFGKVMNATAYGISKT

SEQ ID NO: 4103 - protein, 40 aa, Artificial Sequence
  Description of Artificial Sequence: Synthetic polypeptide
EYDLKWEFPRENLEFGKVLGSGAFGKVMNATAYGISKTGV

SEQ ID NO: 4104 - protein, 40 aa, Artificial Sequence
  Description of Artificial Sequence: Synthetic polypeptide
YDLKWEFPRENLEFGKVLGSGAFGKVMNATAYGISKTGVS

SEQ ID NO: 4105 - protein, 40 aa, Artificial Sequence
  Description of Artificial Sequence: Synthetic polypeptide
HENIVNLLGACTLSGPIYLIFEYCCYGDLLNYLRSKREKF

SEQ ID NO: 4106 - protein, 40 aa, Artificial Sequence
  Description of Artificial Sequence: Synthetic polypeptide
NIVNLLGACTLSGPIYLIFEYCCYGDLLNYLRSKREKFHR

SEQ ID NO: 4107 - protein, 40 aa, Artificial Sequence
  Description of Artificial Sequence: Synthetic polypeptide
DEVKESKRINAEIEKQLRRDKRDARRELKLLLLGTGESGK

SEQ ID NO: 4108 - protein, 40 aa, Artificial Sequence
  Description of Artificial Sequence: Synthetic polypeptide
PDFVGFEIPDKFVVGYALDYNEYFRDLNHVCVISETGKAK

SEQ ID NO: 4109 - protein, 40 aa, Artificial Sequence
  Description of Artificial Sequence: Synthetic polypeptide
VVEMQGDEMTRIIWELIKEKLIFPYVELDLHSYDLGIENR

SEQ ID NO: 4110 - protein, 40 aa, Artificial Sequence
  Description of Artificial Sequence: Synthetic polypeptide
YLRVVRSLCRASGSRPAWAPAALTAPTSQEQPRRHYADKR

SEQ ID NO: 4111 - protein, 40 aa, Artificial Sequence
  Description of Artificial Sequence: Synthetic polypeptide
LCRASGSRPAWAPAALTAPTSQEQPRRHYADKRIKVAKPV

SEQ ID NO: 4112 - protein, 40 aa, Artificial Sequence
  Description of Artificial Sequence: Synthetic polypeptide
PRPSGAGACCRFLPLQSQCPEGAGDAVMYASTECKAEVTP

SEQ ID NO: 4113 - protein, 40 aa, Artificial Sequence
  Description of Artificial Sequence: Synthetic polypeptide
RGARGAWDFLCVLLLLLRVQTGSSQPSVSPGEPSPPSIHP

SEQ ID NO: 4114 - protein, 40 aa, Artificial Sequence
  Description of Artificial Sequence: Synthetic polypeptide
LIVRVGDEIRLLCTDPGFVKWTFEILDETNENKQNEWITE

SEQ ID NO: 4115 - protein, 40 aa, Artificial Sequence
  Description of Artificial Sequence: Synthetic polypeptide
AFPKPEHQQWIYMNRTFTDKWEDYPKSENESNIRYVSELH

SEQ ID NO: 4116 - protein, 40 aa, Artificial Sequence
  Description of Artificial Sequence: Synthetic polypeptide
FPKPEHQQWIYMNRTFTDKWEDYPKSENESNIRYVSELHL

SEQ ID NO: 4117 - protein, 40 aa, Artificial Sequence
  Description of Artificial Sequence: Synthetic polypeptide
PEHQQWIYMNRTFTDKWEDYPKSENESNIRYVSELHLTRL

SEQ ID NO: 4118 - protein, 40 aa, Artificial Sequence
  Description of Artificial Sequence: Synthetic polypeptide
TFTDKWEDYPKSENESNIRYVSELHLTRLKGTEGGTYTFL

SEQ ID NO: 4119 - protein, 40 aa, Artificial Sequence
  Description of Artificial Sequence: Synthetic polypeptide
RLKGTEGGTYTFLVSNSDVNAAIAFNVYVNTKPEILTYDR

SEQ ID NO: 4120 - protein, 40 aa, Artificial Sequence
  Description of Artificial Sequence: Synthetic polypeptide
MPVDVQTLNSSGPPFGKLVVQSSIDSSAFKHNGTVECKAY

SEQ ID NO: 4121 - protein, 40 aa, Artificial Sequence
  Description of Artificial Sequence: Synthetic polypeptide
SSGPPFGKLVVQSSIDSSAFKHNGTVECKAYNDVGKTSAY

SEQ ID NO: 4122 - protein, 40 aa, Artificial Sequence
  Description of Artificial Sequence: Synthetic polypeptide
SGPPFGKLVVQSSIDSSAFKHNGTVECKAYNDVGKTSAYF

SEQ ID NO: 4123 - protein, 40 aa, Artificial Sequence
  Description of Artificial Sequence: Synthetic polypeptide
ITEYCCYGDLLNFLRRKRDSFICSKQEDHAEAALYKNLLH

SEQ ID NO: 4124 - protein, 40 aa, Artificial Sequence
  Description of Artificial Sequence: Synthetic polypeptide
CYGDLLNFLRRKRDSFICSKQEDHAEAALYKNLLHSKESS

SEQ ID NO: 4125 - protein, 40 aa, Artificial Sequence
  Description of Artificial Sequence: Synthetic polypeptide
AALYKNLLHSKESSCSDSTNEYMDMKPGVSYVVPTKADKR

SEQ ID NO: 4126 - protein, 40 aa, Artificial Sequence
  Description of Artificial Sequence: Synthetic polypeptide
MHSKESSCSDSTNEYMDMKPGVSYVVPTKADKRRSVRIGS

SEQ ID NO: 4127 - protein, 40 aa, Artificial Sequence
  Description of Artificial Sequence: Synthetic polypeptide
DSTNEYMDMKPGVSYVVPTKADKRRSVRIGSYIERDVTPA

SEQ ID NO: 4128 - protein, 40 aa, Artificial Sequence
  Description of Artificial Sequence: Synthetic polypeptide
YSAMRDQYMRTGEGFLCVFAINNTKSFEDIHHYREQIKRV

SEQ ID NO: 4129 - protein, 40 aa, Artificial Sequence
  Description of Artificial Sequence: Synthetic polypeptide
SAMRDQYMRTGEGFLCVFAINNTKSFEDIHHYREQIKRVK

SEQ ID NO: 4130 - protein, 40 aa, Artificial Sequence
  Description of Artificial Sequence: Synthetic polypeptide
AMRDQYMRTGEGFLCVFAINNTKSFEDIHHYREQIKRVKD

SEQ ID NO: 4131 - protein, 40 aa, Artificial Sequence
  Description of Artificial Sequence: Synthetic polypeptide
MRDQYMRTGEGFLCVFAINNTKSFEDIHHYREQIKRVKDS

SEQ ID NO: 4132 - protein, 40 aa, Artificial Sequence
  Description of Artificial Sequence: Synthetic polypeptide
RDQYMRTGEGFLCVFAINNTKSFEDIHHYREQIKRVKDSE

SEQ ID NO: 4133 - protein, 40 aa, Artificial Sequence
  Description of Artificial Sequence: Synthetic polypeptide
DQYMRTGEGFLCVFAINNTKSFEDIHHYREQIKRVKDSED

SEQ ID NO: 4134 - protein, 40 aa, Artificial Sequence
  Description of Artificial Sequence: Synthetic polypeptide
QYMRTGEGFLCVFAINNTKSFEDIHHYREQIKRVKDSEDV

SEQ ID NO: 4135 - protein, 40 aa, Artificial Sequence
  Description of Artificial Sequence: Synthetic polypeptide
RTGEGFLCVFAINNTKSFEDIHHYREQIKRVKDSEDVPMV

SEQ ID NO: 4136 - protein, 40 aa, Artificial Sequence
  Description of Artificial Sequence: Synthetic polypeptide
GFLCVFAINNTKSFEDIHHYREQIKRVKDSEDVPMVLVGN

SEQ ID NO: 4137 - protein, 40 aa, Artificial Sequence
  Description of Artificial Sequence: Synthetic polypeptide
FLCVFAINNTKSFEDIHHYREQIKRVKDSEDVPMVLVGNK

SEQ ID NO: 4138 - protein, 40 aa, Artificial Sequence
  Description of Artificial Sequence: Synthetic polypeptide
LCVFAINNTKSFEDIHHYREQIKRVKDSEDVPMVLVGNKC

SEQ ID NO: 4139 - protein, 40 aa, Artificial Sequence
  Description of Artificial Sequence: Synthetic polypeptide
CVFAINNTKSFEDIHHYREQIKRVKDSEDVPMVLVGNKCD

SEQ ID NO: 4140 - protein, 40 aa, Artificial Sequence
  Description of Artificial Sequence: Synthetic polypeptide
VFAINNTKSFEDIHHYREQIKRVKDSEDVPMVLVGNKCDL

SEQ ID NO: 4141 - protein, 40 aa, Artificial Sequence
  Description of Artificial Sequence: Synthetic polypeptide
FAINNTKSFEDIHHYREQIKRVKDSEDVPMVLVGNKCDLP

SEQ ID NO: 4142 - protein, 40 aa, Artificial Sequence
  Description of Artificial Sequence: Synthetic polypeptide
AINNTKSFEDIHHYREQIKRVKDSEDVPMVLVGNKCDLPS

SEQ ID NO: 4143 - protein, 40 aa, Artificial Sequence
  Description of Artificial Sequence: Synthetic polypeptide
SYGIPFIETSAKTRQGVDDAFYTLVREIRKHKEKMSKDGK

SEQ ID NO: 4144 - protein, 40 aa, Artificial Sequence
  Description of Artificial Sequence: Synthetic polypeptide
PFIETSAKTRQRVEDAFYTLVREIRQYRLKKISKEEKTPG

SEQ ID NO: 4145 - protein, 40 aa, Artificial Sequence
  Description of Artificial Sequence: Synthetic polypeptide
PFIETSAKTRQGVDDAFYTLVREIRKHKEKMSKDGKKKKK

SEQ ID NO: 4146 - protein, 40 aa, Artificial Sequence
  Description of Artificial Sequence: Synthetic polypeptide
IETSAKTRQGVDDAFYTLVREIRKHKEKMSKDGKKKKKKS

SEQ ID NO: 4147 - protein, 40 aa, Artificial Sequence
  Description of Artificial Sequence: Synthetic polypeptide
ETSAKTRQRVEDAFYTLVREIRQYRLKKISKEEKTPGCVK

SEQ ID NO: 4148 - protein, 40 aa, Artificial Sequence
  Description of Artificial Sequence: Synthetic polypeptide
TSAKTRQGVDDAFYTLVREIRKHKEKMSKDGKKKKKKSKT

SEQ ID NO: 4149 - protein, 40 aa, Artificial Sequence
  Description of Artificial Sequence: Synthetic polypeptide
SAKTRQRVEDAFYTLVREIRQYRLKKISKEEKTPGCVKIK

SEQ ID NO: 4150 - protein, 40 aa, Artificial Sequence
  Description of Artificial Sequence: Synthetic polypeptide
AKTRQRVEDAFYTLVREIRQYRLKKISKEEKTPGCVKIKK

SEQ ID NO: 4151 - protein, 40 aa, Artificial Sequence
  Description of Artificial Sequence: Synthetic polypeptide
KTRQRVEDAFYTLVREIRQYRLKKISKEEKTPGCVKIKKC

SEQ ID NO: 4152 - protein, 40 aa, Artificial Sequence
  Description of Artificial Sequence: Synthetic polypeptide
KTRQGVDDAFYTLVREIRKHKEKMSKDGKKKKKKSKTKCV

SEQ ID NO: 4153 - protein, 40 aa, Artificial Sequence
  Description of Artificial Sequence: Synthetic polypeptide
TRQGVDDAFYTLVREIRKHKEKMSKDGKKKKKKSKTKCVI

SEQ ID NO: 4154 - protein, 40 aa, Artificial Sequence
  Description of Artificial Sequence: Synthetic polypeptide
RQRVEDAFYTLVREIRQYRLKKISKEEKTPGCVKIKKCII

SEQ ID NO: 4155 - protein, 40 aa, Artificial Sequence
  Description of Artificial Sequence: Synthetic polypeptide
RQGVDDAFYTLVREIRKHKEKMSKDGKKKKKKSKTKCVIM

SEQ ID NO: 4156 - protein, 40 aa, Artificial Sequence
  Description of Artificial Sequence: Synthetic polypeptide
QRVEDAFYTLVREIRQYRLKKISKEEKTPGCVKIKKCIIM

SEQ ID NO: 4157 - protein, 39 aa, Artificial Sequence
  Description of Artificial Sequence: Synthetic polypeptide
QGVDDAFYTLVREIRKHKEKMSKDGKKKKKKSKTKCVIM

SEQ ID NO: 4158 - protein, 39 aa, Artificial Sequence
  Description of Artificial Sequence: Synthetic polypeptide
RVEDAFYTLVREIRQYRLKKISKEEKTPGCVKIKKCIIM

SEQ ID NO: 4159 - protein, 40 aa, Artificial Sequence
  Description of Artificial Sequence: Synthetic polypeptide
TEYKLVVVGACGVGKSALTIQLIQNHFVDEYDPTIEDSYR

SEQ ID NO: 4160 - protein, 40 aa, Artificial Sequence
  Description of Artificial Sequence: Synthetic polypeptide
VVGASGVGKSALTIQLIQNHFVDEYDPTIEDSYRKQVVID

SEQ ID NO: 4161 - protein, 40 aa, Artificial Sequence
  Description of Artificial Sequence: Synthetic polypeptide
QNHFVDEYDPTIEDSYRKQVVIDGETCLLDILDTAGKEEY

SEQ ID NO: 4162 - protein, 40 aa, Artificial Sequence; identical to SEQ ID NO: 2713
  Description of Artificial Sequence: Synthetic polypeptide

SEQ ID NO: 4163 - protein, 40 aa, Artificial Sequence; identical to SEQ ID NO: 1015
  Description of Artificial Sequence: Synthetic polypeptide

SEQ ID NO: 4164 - protein, 40 aa, Artificial Sequence; identical to SEQ ID NO: 1192
  Description of Artificial Sequence: Synthetic polypeptide

SEQ ID NO: 4165 - protein, 40 aa, Artificial Sequence; identical to SEQ ID NO: 1017
  Description of Artificial Sequence: Synthetic polypeptide

SEQ ID NO: 4166 - protein, 40 aa, Artificial Sequence; identical to SEQ ID NO: 1018
  Description of Artificial Sequence: Synthetic polypeptide

SEQ ID NO: 4167 - protein, 40 aa, Artificial Sequence
  Description of Artificial Sequence: Synthetic polypeptide
AGKEEYSAMRDQYMRTGEGFLCVFAINNTKSFEDIHHYRE

SEQ ID NO: 4168 - protein, 40 aa, Artificial Sequence
  Description of Artificial Sequence: Synthetic polypeptide
PKKKPTPIQLNPAPDGSAVNGTSSAETNLEALQKKLEELE

SEQ ID NO: 4169 - protein, 40 aa, Artificial Sequence
  Description of Artificial Sequence: Synthetic polypeptide
TSSAETNLEALQKKLEELELDEQQRKRLEAFLTQKQKVGE

SEQ ID NO: 4170 - protein, 40 aa, Artificial Sequence
  Description of Artificial Sequence: Synthetic polypeptide
MHECNSPYIVGFYGAFYSDGEISICMEHMDGGSLDQVLKK

SEQ ID NO: 4171 - protein, 40 aa, Artificial Sequence
  Description of Artificial Sequence: Synthetic polypeptide
CMEHMDGGSLDQVLKKAGRIPEQILGKVSIAVIKGLTYLR

SEQ ID NO: 4172 - protein, 40 aa, Artificial Sequence
  Description of Artificial Sequence: Synthetic polypeptide
AIFELLDYIVNEPPPKLPSGVFSLEFQDFVNKCLIKNPAE

SEQ ID NO: 4173 - protein, 40 aa, Artificial Sequence
  Description of Artificial Sequence: Synthetic polypeptide
IFELLDYIVNEPPPKLPSGVFSLEFQDFVNKCLIKNPAER

SEQ ID NO: 4174 - protein, 40 aa, Artificial Sequence
  Description of Artificial Sequence: Synthetic polypeptide
ELLDYIVNEPPPKLPSGVFSLEFQDFVNKCLIKNPAERAD

SEQ ID NO: 4175 - protein, 40 aa, Artificial Sequence
  Description of Artificial Sequence: Synthetic polypeptide
MLDYIVNEPPPKLPSGVFSLEFQDFVNKCLIKNPAERADL

SEQ ID NO: 4176 - protein, 40 aa, Artificial Sequence
  Description of Artificial Sequence: Synthetic polypeptide
YIVNEPPPKLPSGVFSLEFQDFVNKCLIKNPAERADLKQL

SEQ ID NO: 4177 - protein, 40 aa, Artificial Sequence
  Description of Artificial Sequence: Synthetic polypeptide
PKLPSGVFSLEFQDFVNKCLIKNPAERADLKQLMVHAFIK

SEQ ID NO: 4178 - protein, 40 aa, Artificial Sequence
  Description of Artificial Sequence: Synthetic polypeptide
MPSGVFSLEFQDFVNKCLIKNPAERADLKQLMVHAFIKRS

SEQ ID NO: 4179 - protein, 40 aa, Artificial Sequence
  Description of Artificial Sequence: Synthetic polypeptide
SGVFSLEFQDFVNKCLIKNPAERADLKQLMVHAFIKRSDA

SEQ ID NO: 4180 - protein, 40 aa, Artificial Sequence
  Description of Artificial Sequence: Synthetic polypeptide
EFQDFVNKCLIKNPAERADLKQLMVHAFIKRSDAEEVDFA

SEQ ID NO: 4181 - protein, 40 aa, Artificial Sequence
  Description of Artificial Sequence: Synthetic polypeptide
SQIPASEQETLVRPKPLLLKLLKSVGAQKDTYTMKEVLFY

SEQ ID NO: 4182 - protein, 40 aa, Artificial Sequence
  Description of Artificial Sequence: Synthetic polypeptide
PASEQETLVRPKPLLLKLLKSVGAQKDTYTMKEVLFYLGQ

SEQ ID NO: 4183 - protein, 40 aa, Artificial Sequence
  Description of Artificial Sequence: Synthetic polypeptide
ASEQETLVRPKPLLLKLLKSVGAQKDTYTMKEVLFYLGQY

SEQ ID NO: 4184 - protein, 40 aa, Artificial Sequence
  Description of Artificial Sequence: Synthetic polypeptide
SEQETLVRPKPLLLKLLKSVGAQKDTYTMKEVLFYLGQYI

SEQ ID NO: 4185 - protein, 40 aa, Artificial Sequence
  Description of Artificial Sequence: Synthetic polypeptide
EQETLVRPKPLLLKLLKSVGAQKDTYTMKEVLFYLGQYIM

SEQ ID NO: 4186 - protein, 40 aa, Artificial Sequence
  Description of Artificial Sequence: Synthetic polypeptide
TLVRPKPLLLKLLKSVGAQKDTYTMKEVLFYLGQYIMTKR

SEQ ID NO: 4187 - protein, 40 aa, Artificial Sequence
  Description of Artificial Sequence: Synthetic polypeptide
RPKPLLLKLLKSVGAQKDTYTMKEVLFYLGQYIMTKRLYD

SEQ ID NO: 4188 - protein, 40 aa, Artificial Sequence
  Description of Artificial Sequence: Synthetic polypeptide
KPLLLKLLKSVGAQKDTYTMKEVLFYLGQYIMTKRLYDEK

SEQ ID NO: 4189 - protein, 40 aa, Artificial Sequence
  Description of Artificial Sequence: Synthetic polypeptide
PLLLKLLKSVGAQKDTYTMKEVLFYLGQYIMTKRLYDEKQ

SEQ ID NO: 4190 - protein, 40 aa, Artificial Sequence
  Description of Artificial Sequence: Synthetic polypeptide
MLLKLLKSVGAQKDTYTMKEVLFYLGQYIMTKRLYDEKQQ

SEQ ID NO: 4191 - protein, 40 aa, Artificial Sequence
  Description of Artificial Sequence: Synthetic polypeptide
MKLLKSVGAQKDTYTMKEVLFYLGQYIMTKRLYDEKQQHI

SEQ ID NO: 4192 - protein, 40 aa, Artificial Sequence
  Description of Artificial Sequence: Synthetic polypeptide
KLLKSVGAQKDTYTMKEVLFYLGQYIMTKRLYDEKQQHIV

SEQ ID NO: 4193 - protein, 40 aa, Artificial Sequence
  Description of Artificial Sequence: Synthetic polypeptide
LLKSVGAQKDTYTMKEVLFYLGQYIMTKRLYDEKQQHIVY

SEQ ID NO: 4194 - protein, 40 aa, Artificial Sequence
  Description of Artificial Sequence: Synthetic polypeptide
LKSVGAQKDTYTMKEVLFYLGQYIMTKRLYDEKQQHIVYC

SEQ ID NO: 4195 - protein, 40 aa, Artificial Sequence
  Description of Artificial Sequence: Synthetic polypeptide
KSVGAQKDTYTMKEVLFYLGQYIMTKRLYDEKQQHIVYCS

SEQ ID NO: 4196 - protein, 40 aa, Artificial Sequence
  Description of Artificial Sequence: Synthetic polypeptide
QKDTYTMKEVLFYLGQYIMTKRLYDEKQQHIVYCSNDLLG

SEQ ID NO: 4197 - protein, 40 aa, Artificial Sequence
  Description of Artificial Sequence: Synthetic polypeptide
KDTYTMKEVLFYLGQYIMTKRLYDEKQQHIVYCSNDLLGD

SEQ ID NO: 4198 - protein, 40 aa, Artificial Sequence
  Description of Artificial Sequence: Synthetic polypeptide
DTYTMKEVLFYLGQYIMTKRLYDEKQQHIVYCSNDLLGDL

SEQ ID NO: 4199 - protein, 40 aa, Artificial Sequence
  Description of Artificial Sequence: Synthetic polypeptide
TMKEVLFYLGQYIMTKRLYDEKQQHIVYCSNDLLGDLFGV

SEQ ID NO: 4200 - protein, 40 aa, Artificial Sequence
  Description of Artificial Sequence: Synthetic polypeptide
MKEVLFYLGQYIMTKRLYDEKQQHIVYCSNDLLGDLFGVP

SEQ ID NO: 4201 - protein, 40 aa, Artificial Sequence
  Description of Artificial Sequence: Synthetic polypeptide
KEVLFYLGQYIMTKRLYDEKQQHIVYCSNDLLGDLFGVPS

SEQ ID NO: 4202 - protein, 40 aa, Artificial Sequence
  Description of Artificial Sequence: Synthetic polypeptide
EVLFYLGQYIMTKRLYDEKQQHIVYCSNDLLGDLFGVPSF

SEQ ID NO: 4203 - protein, 40 aa, Artificial Sequence
  Description of Artificial Sequence: Synthetic polypeptide
VLFYLGQYIMTKRLYDEKQQHIVYCSNDLLGDLFGVPSFS

SEQ ID NO: 4204 - protein, 40 aa, Artificial Sequence
  Description of Artificial Sequence: Synthetic polypeptide
GVPSFSVKEHRKIYTMIYRNLVVVNQQESSDSGTSVSENR

SEQ ID NO: 4205 - protein, 40 aa, Artificial Sequence
  Description of Artificial Sequence: Synthetic polypeptide
EGGSDQKDLVQELQEEKPSSSHLVSRPSTSSRRRAISETE

SEQ ID NO: 4206 - protein, 40 aa, Artificial Sequence
  Description of Artificial Sequence: Synthetic polypeptide
SLALCVIREICCERSSSSESTGTPSNPDLDAGVSEHSGDW

SEQ ID NO: 4207 - protein, 40 aa, Artificial Sequence
  Description of Artificial Sequence: Synthetic polypeptide
MCVIREICCERSSSSESTGTPSNPDLDAGVSEHSGDWLDQ

SEQ ID NO: 4208 - protein, 40 aa, Artificial Sequence
  Description of Artificial Sequence: Synthetic polypeptide
CVIREICCERSSSSESTGTPSNPDLDAGVSEHSGDWLDQD

SEQ ID NO: 4209 - protein, 40 aa, Artificial Sequence
  Description of Artificial Sequence: Synthetic polypeptide
IREICCERSSSSESTGTPSNPDLDAGVSEHSGDWLDQDSV

SEQ ID NO: 4210 - protein, 40 aa, Artificial Sequence
  Description of Artificial Sequence: Synthetic polypeptide
REICCERSSSSESTGTPSNPDLDAGVSEHSGDWLDQDSVS

SEQ ID NO: 4211 - protein, 40 aa, Artificial Sequence
  Description of Artificial Sequence: Synthetic polypeptide
EICCERSSSSESTGTPSNPDLDAGVSEHSGDWLDQDSVSD

SEQ ID NO: 4212 - protein, 40 aa, Artificial Sequence
  Description of Artificial Sequence: Synthetic polypeptide
GTPSNPDLDAGVSEHSGDWLDQDSVSDQFSVEFEVESLDS

SEQ ID NO: 4213 - protein, 40 aa, Artificial Sequence
  Description of Artificial Sequence: Synthetic polypeptide
TPSNPDLDAGVSEHSGDWLDQDSVSDQFSVEFEVESLDSE

SEQ ID NO: 4214 - protein, 40 aa, Artificial Sequence
  Description of Artificial Sequence: Synthetic polypeptide
PSNPDLDAGVSEHSGDWLDQDSVSDQFSVEFEVESLDSED

SEQ ID NO: 4215 - protein, 40 aa, Artificial Sequence
  Description of Artificial Sequence: Synthetic polypeptide
WLPEDKGKDKGEISEKAKLENSTQAEEGFDVPDCKKTIVN

SEQ ID NO: 4216 - protein, 40 aa, Artificial Sequence
  Description of Artificial Sequence: Synthetic polypeptide
EEGFDVPDCKKTIVNDSRESCVEENDDKITQASQSQESED

SEQ ID NO: 4217 - protein, 40 aa, Artificial Sequence
  Description of Artificial Sequence: Synthetic polypeptide
EGFDVPDCKKTIVNDSRESCVEENDDKITQASQSQESEDY

SEQ ID NO: 4218 - protein, 40 aa, Artificial Sequence
  Description of Artificial Sequence: Synthetic polypeptide
PDCKKTIVNDSRESCVEENDDKITQASQSQESEDYSQPST

SEQ ID NO: 4219 - protein, 40 aa, Artificial Sequence
  Description of Artificial Sequence: Synthetic polypeptide
DCKKTIVNDSRESCVEENDDKITQASQSQESEDYSQPSTS

SEQ ID NO: 4220 - protein, 40 aa, Artificial Sequence
  Description of Artificial Sequence: Synthetic polypeptide
CKKTIVNDSRESCVEENDDKITQASQSQESEDYSQPSTSS

SEQ ID NO: 4221 - protein, 40 aa, Artificial Sequence
  Description of Artificial Sequence: Synthetic polypeptide
AIEPCVICQGRPKNGCIVHGKTGHLMACFTCAKKLKKRNK

SEQ ID NO: 4222 - protein, 40 aa, Artificial Sequence
  Description of Artificial Sequence: Synthetic polypeptide
TSFSTSAQCSTSDSACRISPGQINQVRPKLPLLKILHAAG

SEQ ID NO: 4223 - protein, 40 aa, Artificial Sequence
  Description of Artificial Sequence: Synthetic polypeptide
CRISPGQINQVRPKLPLLKILHAAGAQGEMFTVKEVMHYL

SEQ ID NO: 4224 - protein, 40 aa, Artificial Sequence
  Description of Artificial Sequence: Synthetic polypeptide
SAEESSTSRKRTTEDDIPTLPTSEHKCIHSREDEDLIENL

SEQ ID NO: 4225 - protein, 40 aa, Artificial Sequence
  Description of Artificial Sequence: Synthetic polypeptide
WDVAGLPWWFLGNLRSNYTPRSNGSTDLQTNQDVGTAIVS

SEQ ID NO: 4226 - protein, 40 aa, Artificial Sequence
  Description of Artificial Sequence: Synthetic polypeptide
STDLQTNQDVGTAIVSDTTDDLWFLNESVSEQLGVGIKVE

SEQ ID NO: 4227 - protein, 40 aa, Artificial Sequence
  Description of Artificial Sequence: Synthetic polypeptide
MWFLNESVSEQLGVGIKVEAADTEQTSEEVGKVSDKKVIE

SEQ ID NO: 4228 - protein, 40 aa, Artificial Sequence
  Description of Artificial Sequence: Synthetic polypeptide
WFLNESVSEQLGVGIKVEAADTEQTSEEVGKVSDKKVIEV

SEQ ID NO: 4229 - protein, 40 aa, Artificial Sequence
  Description of Artificial Sequence: Synthetic polypeptide
FLNESVSEQLGVGIKVEAADTEQTSEEVGKVSDKKVIEVG

SEQ ID NO: 4230 - protein, 40 aa, Artificial Sequence
  Description of Artificial Sequence: Synthetic polypeptide
VSEQLGVGIKVEAADTEQTSEEVGKVSDKKVIEVGKNDDL

SEQ ID NO: 4231 - protein, 40 aa, Artificial Sequence
  Description of Artificial Sequence: Synthetic polypeptide
SEQLGVGIKVEAADTEQTSEEVGKVSDKKVIEVGKNDDLE

SEQ ID NO: 4232 - protein, 40 aa, Artificial Sequence
  Description of Artificial Sequence: Synthetic polypeptide
EQLGVGIKVEAADTEQTSEEVGKVSDKKVIEVGKNDDLED

SEQ ID NO: 4233 - protein, 40 aa, Artificial Sequence
  Description of Artificial Sequence: Synthetic polypeptide
QLGVGIKVEAADTEQTSEEVGKVSDKKVIEVGKNDDLEDS

SEQ ID NO: 4234 - protein, 40 aa, Artificial Sequence
  Description of Artificial Sequence: Synthetic polypeptide
GVGIKVEAADTEQTSEEVGKVSDKKVIEVGKNDDLEDSKS

SEQ ID NO: 4235 - protein, 40 aa, Artificial Sequence
  Description of Artificial Sequence: Synthetic polypeptide
VGIKVEAADTEQTSEEVGKVSDKKVIEVGKNDDLEDSKSL

SEQ ID NO: 4236 - protein, 40 aa, Artificial Sequence
  Description of Artificial Sequence: Synthetic polypeptide
DTEQTSEEVGKVSDKKVIEVGKNDDLEDSKSLSDDTDVEV

SEQ ID NO: 4237 - protein, 40 aa, Artificial Sequence
  Description of Artificial Sequence: Synthetic polypeptide
EEVGKVSDKKVIEVGKNDDLEDSKSLSDDTDVEVTSEDEW

SEQ ID NO: 4238 - protein, 40 aa, Artificial Sequence
  Description of Artificial Sequence: Synthetic polypeptide
EDSKSLSDDTDVEVTSEDEWQCTECKKFNSPSKRYCFRCW

SEQ ID NO: 4239 - protein, 40 aa, Artificial Sequence
  Description of Artificial Sequence: Synthetic polypeptide
TDVEVTSEDEWQCTECKKFNSPSKRYCFRCWALRKDWYSD

SEQ ID NO: 4240 - protein, 40 aa, Artificial Sequence
  Description of Artificial Sequence: Synthetic polypeptide
EDEWQCTECKKFNSPSKRYCFRCWALRKDWYSDCSKLTHS

SEQ ID NO: 4241 - protein, 40 aa, Artificial Sequence
  Description of Artificial Sequence: Synthetic polypeptide
EWQCTECKKFNSPSKRYCFRCWALRKDWYSDCSKLTHSLS

SEQ ID NO: 4242 - protein, 40 aa, Artificial Sequence
  Description of Artificial Sequence: Synthetic polypeptide
RCWALRKDWYSDCSKLTHSLSTSDITAIPEKENEGNDVPD

SEQ ID NO: 4243 - protein, 40 aa, Artificial Sequence
  Description of Artificial Sequence: Synthetic polypeptide
TAIPEKENEGNDVPDCRRTISAPVVRPKDAYIKKENSKLF

SEQ ID NO: 4244 - protein, 40 aa, Artificial Sequence
  Description of Artificial Sequence: Synthetic polypeptide
AIPEKENEGNDVPDCRRTISAPVVRPKDAYIKKENSKLFD

SEQ ID NO: 4245 - protein, 40 aa, Artificial Sequence
  Description of Artificial Sequence: Synthetic polypeptide
IPEKENEGNDVPDCRRTISAPVVRPKDAYIKKENSKLFDP

SEQ ID NO: 4246 - protein, 40 aa, Artificial Sequence
  Description of Artificial Sequence: Synthetic polypeptide
PEKENEGNDVPDCRRTISAPVVRPKDAYIKKENSKLFDPC

SEQ ID NO: 4247 - protein, 40 aa, Artificial Sequence
  Description of Artificial Sequence: Synthetic polypeptide
KENEGNDVPDCRRTISAPVVRPKDAYIKKENSKLFDPCNS

SEQ ID NO: 4248 - protein, 40 aa, Artificial Sequence
  Description of Artificial Sequence: Synthetic polypeptide
ENEGNDVPDCRRTISAPVVRPKDAYIKKENSKLFDPCNSV

SEQ ID NO: 4249 - protein, 40 aa, Artificial Sequence
  Description of Artificial Sequence: Synthetic polypeptide
NEGNDVPDCRRTISAPVVRPKDAYIKKENSKLFDPCNSVE

SEQ ID NO: 4250 - protein, 40 aa, Artificial Sequence
  Description of Artificial Sequence: Synthetic polypeptide
EGNDVPDCRRTISAPVVRPKDAYIKKENSKLFDPCNSVEF

SEQ ID NO: 4251 - protein, 40 aa, Artificial Sequence
  Description of Artificial Sequence: Synthetic polypeptide
GNDVPDCRRTISAPVVRPKDAYIKKENSKLFDPCNSVEFL

SEQ ID NO: 4252 - protein, 40 aa, Artificial Sequence
  Description of Artificial Sequence: Synthetic polypeptide
NDVPDCRRTISAPVVRPKDAYIKKENSKLFDPCNSVEFLD

SEQ ID NO: 4253 - protein, 40 aa, Artificial Sequence
  Description of Artificial Sequence: Synthetic polypeptide
DVPDCRRTISAPVVRPKDAYIKKENSKLFDPCNSVEFLDL

SEQ ID NO: 4254 - protein, 40 aa, Artificial Sequence
  Description of Artificial Sequence: Synthetic polypeptide
VPDCRRTISAPVVRPKDAYIKKENSKLFDPCNSVEFLDLA

SEQ ID NO: 4255 - protein, 40 aa, Artificial Sequence
  Description of Artificial Sequence: Synthetic polypeptide
RRTISAPVVRPKDAYIKKENSKLFDPCNSVEFLDLAHSSE

SEQ ID NO: 4256 - protein, 40 aa, Artificial Sequence
  Description of Artificial Sequence: Synthetic polypeptide
TISAPVVRPKDAYIKKENSKLFDPCNSVEFLDLAHSSESQ

SEQ ID NO: 4257 - protein, 40 aa, Artificial Sequence
  Description of Artificial Sequence: Synthetic polypeptide
ISAPVVRPKDAYIKKENSKLFDPCNSVEFLDLAHSSESQE

SEQ ID NO: 4258 - protein, 40 aa, Artificial Sequence
  Description of Artificial Sequence: Synthetic polypeptide
SAPVVRPKDAYIKKENSKLFDPCNSVEFLDLAHSSESQET

SEQ ID NO: 4259 - protein, 40 aa, Artificial Sequence
  Description of Artificial Sequence: Synthetic polypeptide
APVVRPKDAYIKKENSKLFDPCNSVEFLDLAHSSESQETI

SEQ ID NO: 4260 - protein, 40 aa, Artificial Sequence
  Description of Artificial Sequence: Synthetic polypeptide
PVVRPKDAYIKKENSKLFDPCNSVEFLDLAHSSESQETIS

SEQ ID NO: 4261 - protein, 40 aa, Artificial Sequence
  Description of Artificial Sequence: Synthetic polypeptide
VVRPKDAYIKKENSKLFDPCNSVEFLDLAHSSESQETISS

SEQ ID NO: 4262 - protein, 40 aa, Artificial Sequence
  Description of Artificial Sequence: Synthetic polypeptide
DAYIKKENSKLFDPCNSVEFLDLAHSSESQETISSMGEQL

SEQ ID NO: 4263 - protein, 40 aa, Artificial Sequence
  Description of Artificial Sequence: Synthetic polypeptide
VLAPGILVLLFTLVQRSNGECKEALAKSEMNVNMKYQLPN

SEQ ID NO: 4264 - protein, 40 aa, Artificial Sequence
  Description of Artificial Sequence: Synthetic polypeptide
EEPSQCPDCVVSALGAKVLSSVKDRFINFFVGNTINSSYF

SEQ ID NO: 4265 - protein, 40 aa, Artificial Sequence
  Description of Artificial Sequence: Synthetic polypeptide
CPDCVVSALGAKVLSSVKDRFINFFVGNTINSSYFPDHPL

SEQ ID NO: 4266 - protein, 40 aa, Artificial Sequence
  Description of Artificial Sequence: Synthetic polypeptide
RDSYPIKYVHAFESNNFIYFLTVQRETLDAQTFHTRIIRF

SEQ ID NO: 4267 - protein, 40 aa, Artificial Sequence
  Description of Artificial Sequence: Synthetic polypeptide
IKYVHAFESNNFIYFLTVQRETLDAQTFHTRIIRFCSINS

SEQ ID NO: 4268 - protein, 40 aa, Artificial Sequence
  Description of Artificial Sequence: Synthetic polypeptide
AFESNNFIYFLTVQRETLDAQTFHTRIIRFCSINSGLHSY

SEQ ID NO: 4269 - protein, 40 aa, Artificial Sequence
  Description of Artificial Sequence: Synthetic polypeptide
ETLDAQTFHTRIIRFCSINSGLHSYMEMPLECILTEKRKK

SEQ ID NO: 4270 - protein, 40 aa, Artificial Sequence
  Description of Artificial Sequence: Synthetic polypeptide
DAQTFHTRIIRFCSINSGLHSYMEMPLECILTEKRKKRST

SEQ ID NO: 4271 - protein, 40 aa, Artificial Sequence
  Description of Artificial Sequence: Synthetic polypeptide
MECILTEKRKKRSTKKEVFNILQAAYVSKPGAQLARQIGA

SEQ ID NO: 4272 - protein, 40 aa, Artificial Sequence
  Description of Artificial Sequence: Synthetic polypeptide
PLEGGTRLTICGWDFGFRRNNKFDLKKTRVLLGNESCTLT

SEQ ID NO: 4273 - protein, 40 aa, Artificial Sequence
  Description of Artificial Sequence: Synthetic polypeptide
EGGTRLTICGWDFGFRRNNKFDLKKTRVLLGNESCTLTLS

SEQ ID NO: 4274 - protein, 40 aa, Artificial Sequence
  Description of Artificial Sequence: Synthetic polypeptide
GGTRLTICGWDFGFRRNNKFDLKKTRVLLGNESCTLTLSE

SEQ ID NO: 4275 - protein, 40 aa, Artificial Sequence
  Description of Artificial Sequence: Synthetic polypeptide
ICGWDFGFRRNNKFDLKKTRVLLGNESCTLTLSESTMNTL

SEQ ID NO: 4276 - protein, 40 aa, Artificial Sequence
  Description of Artificial Sequence: Synthetic polypeptide
CGWDFGFRRNNKFDLKKTRVLLGNESCTLTLSESTMNTLK

SEQ ID NO: 4277 - protein, 40 aa, Artificial Sequence
  Description of Artificial Sequence: Synthetic polypeptide
WDFGFRRNNKFDLKKTRVLLGNESCTLTLSESTMNTLKCT

SEQ ID NO: 4278 - protein, 40 aa, Artificial Sequence
  Description of Artificial Sequence: Synthetic polypeptide
DFGFRRNNKFDLKKTRVLLGNESCTLTLSESTMNTLKCTV

SEQ ID NO: 4279 - protein, 40 aa, Artificial Sequence
  Description of Artificial Sequence: Synthetic polypeptide
IISNGHGTTQYSTFSYVDPVITSISPKYGPMAGGTLLTLT

SEQ ID NO: 4280 - protein, 40 aa, Artificial Sequence
  Description of Artificial Sequence: Synthetic polypeptide
KTCTLKSVSNSILECYTPAQTISTEFAVKLKIDLANRETS

SEQ ID NO: 4281 - protein, 40 aa, Artificial Sequence
  Description of Artificial Sequence: Synthetic polypeptide
LKSVSNSILECYTPAQTISTEFAVKLKIDLANRETSIFSY

SEQ ID NO: 4282 - protein, 40 aa, Artificial Sequence
  Description of Artificial Sequence: Synthetic polypeptide
SVSNSILECYTPAQTISTEFAVKLKIDLANRETSIFSYRE

SEQ ID NO: 4283 - protein, 40 aa, Artificial Sequence
  Description of Artificial Sequence: Synthetic polypeptide
AFFMLDGILSKYFDLIYVHNPVFKPFEKPVMISMGNENVL

SEQ ID NO: 4284 - protein, 40 aa, Artificial Sequence
  Description of Artificial Sequence: Synthetic polypeptide
YFDLIYVHNPVFKPFEKPVMISMGNENVLEIKGNDIDPEA

SEQ ID NO: 4285 - protein, 40 aa, Artificial Sequence
  Description of Artificial Sequence: Synthetic polypeptide
VFKPFEKPVMISMGNENVLEIKGNDIDPEAVKGEVLKVGN

SEQ ID NO: 4286 - protein, 40 aa, Artificial Sequence
  Description of Artificial Sequence: Synthetic polypeptide
VMISMGNENVLEIKGNDIDPEAVKGEVLKVGNKSCENIHL

SEQ ID NO: 4287 - protein, 40 aa, Artificial Sequence
  Description of Artificial Sequence: Synthetic polypeptide
ISMGNENVLEIKGNDIDPEAVKGEVLKVGNKSCENIHLHS

SEQ ID NO: 4288 - protein, 40 aa, Artificial Sequence
  Description of Artificial Sequence: Synthetic polypeptide
NENVLEIKGNDIDPEAVKGEVLKVGNKSCENIHLHSEAVL

SEQ ID NO: 4289 - protein, 40 aa, Artificial Sequence
  Description of Artificial Sequence: Synthetic polypeptide
ENVLEIKGNDIDPEAVKGEVLKVGNKSCENIHLHSEAVLC

SEQ ID NO: 4290 - protein, 40 aa, Artificial Sequence
  Description of Artificial Sequence: Synthetic polypeptide
VLEIKGNDIDPEAVKGEVLKVGNKSCENIHLHSEAVLCTV

SEQ ID NO: 4291 - protein, 40 aa, Artificial Sequence
  Description of Artificial Sequence: Synthetic polypeptide
MEIKGNDIDPEAVKGEVLKVGNKSCENIHLHSEAVLCTVP

SEQ ID NO: 4292 - protein, 40 aa, Artificial Sequence
  Description of Artificial Sequence: Synthetic polypeptide
VKGEVLKVGNKSCENIHLHSEAVLCTVPNDLLKLNSELNI

SEQ ID NO: 4293 - protein, 40 aa, Artificial Sequence
  Description of Artificial Sequence: Synthetic polypeptide
LSALNPELVQAVQHVVIGPSSLIVHFNEVIGRGHFGCVYH

SEQ ID NO: 4294 - protein, 40 aa, Artificial Sequence
  Description of Artificial Sequence: Synthetic polypeptide
SDVWSFGVLLWELMTRGAPPYPDVNTFDITVYLLQGRRLL

SEQ ID NO: 4295 - protein, 40 aa, Artificial Sequence
  Description of Artificial Sequence: Synthetic polypeptide
LLQPEYCPDPLYEVMLKCWHPKAEMRPSFSELVSRISAIF

SEQ ID NO: 4296 - protein, 40 aa, Artificial Sequence
  Description of Artificial Sequence: Synthetic polypeptide
ELVSRISAIFSTFIGEHYVHVNATYVNVKCVAPYPSLLSS

SEQ ID NO: 4297 - protein, 40 aa, Artificial Sequence
  Description of Artificial Sequence: Synthetic polypeptide
AIFSTFIGEHYVHVNATYVNVKCVAPYPSLLSSEDNADDE

SEQ ID NO: 4298 - protein, 40 aa, Artificial Sequence
  Description of Artificial Sequence: Synthetic polypeptide
STRFYDQLNHHIFELVSSSDANERKGGILAIASLIGVEGG

SEQ ID NO: 4299 - protein, 40 aa, Artificial Sequence
  Description of Artificial Sequence: Synthetic polypeptide
EASDVGSITLALRTLGSFEFEGHSLTQFVRHCADHFLNSE

SEQ ID NO: 4300 - protein, 40 aa, Artificial Sequence
  Description of Artificial Sequence: Synthetic polypeptide
ALILKLKDPDPDPNPGVINNVLATIGELAQVSGLEMRKWV

SEQ ID NO: 4301 - protein, 40 aa, Artificial Sequence
  Description of Artificial Sequence: Synthetic polypeptide
MKDPDPDPNPGVINNVLATIGELAQVSGLEMRKWVDELFI

SEQ ID NO: 4302 - protein, 40 aa, Artificial Sequence
  Description of Artificial Sequence: Synthetic polypeptide
DSSLLAKRQVALWTLGQLVASTGYVVEPYRKYPTLLEVLL

SEQ ID NO: 4303 - protein, 40 aa, Artificial Sequence
  Description of Artificial Sequence: Synthetic polypeptide
MRSTAMDTLSSLVFQLGKKYQIFIPMVNKVLVRHRINHQR

SEQ ID NO: 4304 - protein, 40 aa, Artificial Sequence
  Description of Artificial Sequence: Synthetic polypeptide
EGLEEASRLYFGERNVKGMFEVLEPLHAMMERGPQTLKET

SEQ ID NO: 4305 - protein, 40 aa, Artificial Sequence
  Description of Artificial Sequence: Synthetic polypeptide
VFEHAVNNTAGDDLAKLLWLKSPSSEVWFDRRTNYTRSLA

SEQ ID NO: 4306 - protein, 40 aa, Artificial Sequence
  Description of Artificial Sequence: Synthetic polypeptide
SVEILDGVELGEPAHKKTGTTVPESIHSFIGDGLVKPEAL

SEQ ID NO: 4307 - protein, 40 aa, Artificial Sequence
  Description of Artificial Sequence: Synthetic polypeptide
GVELGEPAHKKTGTTVPESIHSFIGDGLVKPEALNKKAIQ

SEQ ID NO: 4308 - protein, 40 aa, Artificial Sequence
  Description of Artificial Sequence: Synthetic polypeptide
ELGEPAHKKTGTTVPESIHSFIGDGLVKPEALNKKAIQII

SEQ ID NO: 4309 - protein, 40 aa, Artificial Sequence
  Description of Artificial Sequence: Synthetic polypeptide
GEPAHKKTGTTVPESIHSFIGDGLVKPEALNKKAIQIINR

SEQ ID NO: 4310 - protein, 40 aa, Artificial Sequence
  Description of Artificial Sequence: Synthetic polypeptide
EPAHKKTGTTVPESIHSFIGDGLVKPEALNKKAIQIINRV

SEQ ID NO: 4311 - protein, 40 aa, Artificial Sequence
  Description of Artificial Sequence: Synthetic polypeptide
PAHKKTGTTVPESIHSFIGDGLVKPEALNKKAIQIINRVR

SEQ ID NO: 4312 - protein, 40 aa, Artificial Sequence
  Description of Artificial Sequence: Synthetic polypeptide
VLERQRRNELKRSFFALRDQIPELENNEKAPKVVILKKAT

SEQ ID NO: 4313 - protein, 40 aa, Artificial Sequence
  Description of Artificial Sequence: Synthetic polypeptide
MERQRRNELKRSFFALRDQIPELENNEKAPKVVILKKATA

SEQ ID NO: 4314 - protein, 40 aa, Artificial Sequence
  Description of Artificial Sequence: Synthetic polypeptide
QRRNELKRSFFALRDQIPELENNEKAPKVVILKKATAYIL

SEQ ID NO: 4315 - protein, 40 aa, Artificial Sequence
  Description of Artificial Sequence: Synthetic polypeptide
MENNEKAPKVVILKKATAYILSVQAEEQKLISEEDLLRKR

SEQ ID NO: 4316 - protein, 40 aa, Artificial Sequence
  Description of Artificial Sequence: Synthetic polypeptide
ENNEKAPKVVILKKATAYILSVQAEEQKLISEEDLLRKRR

SEQ ID NO: 4317 - protein, 40 aa, Artificial Sequence
  Description of Artificial Sequence: Synthetic polypeptide
NEKAPKVVILKKATAYILSVQAEEQKLISEEDLLRKRREQ

SEQ ID NO: 4318 - protein, 40 aa, Artificial Sequence
  Description of Artificial Sequence: Synthetic polypeptide
SQEEASERGPQEEVLERDAAGEKEDEEDEEIVSPPPVESE

SEQ ID NO: 4319 - protein, 40 aa, Artificial Sequence
  Description of Artificial Sequence: Synthetic polypeptide
FGLGGLGGLTPNPVILQDCMWSGFSAREKLERAVSEKLQH

SEQ ID NO: 4320 - protein, 40 aa, Artificial Sequence
  Description of Artificial Sequence: Synthetic polypeptide
FPVNKREPAPVPAAPASAPAAGPAVASGAGIAAPAGAPGV

SEQ ID NO: 4321 - protein, 40 aa, Artificial Sequence
  Description of Artificial Sequence: Synthetic polypeptide
PVNKREPAPVPAAPASAPAAGPAVASGAGIAAPAGAPGVA

SEQ ID NO: 4322 - protein, 40 aa, Artificial Sequence
  Description of Artificial Sequence: Synthetic polypeptide
VNKREPAPVPAAPASAPAAGPAVASGAGIAAPAGAPGVAP

SEQ ID NO: 4323 - protein, 40 aa, Artificial Sequence
  Description of Artificial Sequence: Synthetic polypeptide
NKREPAPVPAAPASAPAAGPAVASGAGIAAPAGAPGVAPP

SEQ ID NO: 4324 - protein, 40 aa, Artificial Sequence
  Description of Artificial Sequence: Synthetic polypeptide
KREPAPVPAAPASAPAAGPAVASGAGIAAPAGAPGVAPPR

SEQ ID NO: 4325 - protein, 40 aa, Artificial Sequence
  Description of Artificial Sequence: Synthetic polypeptide
EPAPVPAAPASAPAAGPAVASGAGIAAPAGAPGVAPPRPG

SEQ ID NO: 4326 - protein, 40 aa, Artificial Sequence
  Description of Artificial Sequence: Synthetic polypeptide
PAPVPAAPASAPAAGPAVASGAGIAAPAGAPGVAPPRPGG

SEQ ID NO: 4327 - protein, 40 aa, Artificial Sequence
  Description of Artificial Sequence: Synthetic polypeptide
VPAAPASAPAAGPAVASGAGIAAPAGAPGVAPPRPGGRQT

SEQ ID NO: 4328 - protein, 40 aa, Artificial Sequence
  Description of Artificial Sequence: Synthetic polypeptide
PLASDSRKRKLPCDTPGQGLTCSGEKRRREQESKYIEELA

SEQ ID NO: 4329 - protein, 40 aa, Artificial Sequence
  Description of Artificial Sequence: Synthetic polypeptide
MASDSRKRKLPCDTPGQGLTCSGEKRRREQESKYIEELAE

SEQ ID NO: 4330 - protein, 40 aa, Artificial Sequence
  Description of Artificial Sequence: Synthetic polypeptide
REQESKYIEELAELISANLSDIDNFNVKPDKCAILKETVR

SEQ ID NO: 4331 - protein, 40 aa, Artificial Sequence
  Description of Artificial Sequence: Synthetic polypeptide
QESKYIEELAELISANLSDIDNFNVKPDKCAILKETVRQI

SEQ ID NO: 4332 - protein, 40 aa, Artificial Sequence
  Description of Artificial Sequence: Synthetic polypeptide
SKYIEELAELISANLSDIDNFNVKPDKCAILKETVRQIRQ

SEQ ID NO: 4333 - protein, 40 aa, Artificial Sequence
  Description of Artificial Sequence: Synthetic polypeptide
IEELAELISANLSDIDNFNVKPDKCAILKETVRQIRQIKE

SEQ ID NO: 4334 - protein, 40 aa, Artificial Sequence
  Description of Artificial Sequence: Synthetic polypeptide
ELISANLSDIDNFNVKPDKCAILKETVRQIRQIKEQGKTI

SEQ ID NO: 4335 - protein, 40 aa, Artificial Sequence
  Description of Artificial Sequence: Synthetic polypeptide
MISANLSDIDNFNVKPDKCAILKETVRQIRQIKEQGKTIS

SEQ ID NO: 4336 - protein, 40 aa, Artificial Sequence
  Description of Artificial Sequence: Synthetic polypeptide
NFNVKPDKCAILKETVRQIRQIKEQGKTISNDDDVQKADV

SEQ ID NO: 4337 - protein, 40 aa, Artificial Sequence
  Description of Artificial Sequence: Synthetic polypeptide
KPDKCAILKETVRQIRQIKEQGKTISNDDDVQKADVSSTG

SEQ ID NO: 4338 - protein, 40 aa, Artificial Sequence
  Description of Artificial Sequence: Synthetic polypeptide
ILKETVRQIRQIKEQGKTISNDDDVQKADVSSTGQGVIDK

SEQ ID NO: 4339 - protein, 40 aa, Artificial Sequence
  Description of Artificial Sequence: Synthetic polypeptide
KADVSSTGQGVIDKDSLGPLLLQALDGFLFVVNRDGNIVF

SEQ ID NO: 4340 - protein, 40 aa, Artificial Sequence
  Description of Artificial Sequence: Synthetic polypeptide
GQGVIDKDSLGPLLLQALDGFLFVVNRDGNIVFVSENVTQ

SEQ ID NO: 4341 - protein, 40 aa, Artificial Sequence
  Description of Artificial Sequence: Synthetic polypeptide
GVIDKDSLGPLLLQALDGFLFVVNRDGNIVFVSENVTQYL

SEQ ID NO: 4342 - protein, 40 aa, Artificial Sequence
  Description of Artificial Sequence: Synthetic polypeptide
VIDKDSLGPLLLQALDGFLFVVNRDGNIVFVSENVTQYLQ

SEQ ID NO: 4343 - protein, 40 aa, Artificial Sequence
  Description of Artificial Sequence: Synthetic polypeptide
SLGPLLLQALDGFLFVVNRDGNIVFVSENVTQYLQYKQED

SEQ ID NO: 4344 - protein, 40 aa, Artificial Sequence
  Description of Artificial Sequence: Synthetic polypeptide
LLQALDGFLFVVNRDGNIVFVSENVTQYLQYKQEDLVNTS

SEQ ID NO: 4345 - protein, 40 aa, Artificial Sequence
  Description of Artificial Sequence: Synthetic polypeptide
LQALDGFLFVVNRDGNIVFVSENVTQYLQYKQEDLVNTSV

SEQ ID NO: 4346 - protein, 40 aa, Artificial Sequence
  Description of Artificial Sequence: Synthetic polypeptide
ALDGFLFVVNRDGNIVFVSENVTQYLQYKQEDLVNTSVYN

SEQ ID NO: 4347 - protein, 40 aa, Artificial Sequence
  Description of Artificial Sequence: Synthetic polypeptide
DGFLFVVNRDGNIVFVSENVTQYLQYKQEDLVNTSVYNIL

SEQ ID NO: 4348 - protein, 40 aa, Artificial Sequence
  Description of Artificial Sequence: Synthetic polypeptide
DGNIVFVSENVTQYLQYKQEDLVNTSVYNILHEEDRKDFL

SEQ ID NO: 4349 - protein, 40 aa, Artificial Sequence
  Description of Artificial Sequence: Synthetic polypeptide
MVNTSVYNILHEEDRKDFLKNLPKSTVNGVSWTNETQRQK

SEQ ID NO: 4350 - protein, 40 aa, Artificial Sequence
  Description of Artificial Sequence: Synthetic polypeptide
VNTSVYNILHEEDRKDFLKNLPKSTVNGVSWTNETQRQKS

SEQ ID NO: 4351 - protein, 40 aa, Artificial Sequence
  Description of Artificial Sequence: Synthetic polypeptide
TSVYNILHEEDRKDFLKNLPKSTVNGVSWTNETQRQKSHT

SEQ ID NO: 4352 - protein, 40 aa, Artificial Sequence
  Description of Artificial Sequence: Synthetic polypeptide
SVYNILHEEDRKDFLKNLPKSTVNGVSWTNETQRQKSHTF

SEQ ID NO: 4353 - protein, 40 aa, Artificial Sequence
  Description of Artificial Sequence: Synthetic polypeptide
VYNILHEEDRKDFLKNLPKSTVNGVSWTNETQRQKSHTFN

SEQ ID NO: 4354 - protein, 40 aa, Artificial Sequence
  Description of Artificial Sequence: Synthetic polypeptide
YNILHEEDRKDFLKNLPKSTVNGVSWTNETQRQKSHTFNC

SEQ ID NO: 4355 - protein, 40 aa, Artificial Sequence
  Description of Artificial Sequence: Synthetic polypeptide
NILHEEDRKDFLKNLPKSTVNGVSWTNETQRQKSHTFNCR

SEQ ID NO: 4356 - protein, 40 aa, Artificial Sequence
  Description of Artificial Sequence: Synthetic polypeptide
ILHEEDRKDFLKNLPKSTVNGVSWTNETQRQKSHTFNCRM

SEQ ID NO: 4357 - protein, 40 aa, Artificial Sequence
  Description of Artificial Sequence: Synthetic polypeptide
LHEEDRKDFLKNLPKSTVNGVSWTNETQRQKSHTFNCRML

SEQ ID NO: 4358 - protein, 40 aa, Artificial Sequence
  Description of Artificial Sequence: Synthetic polypeptide
HEEDRKDFLKNLPKSTVNGVSWTNETQRQKSHTFNCRMLM

SEQ ID NO: 4359 - protein, 40 aa, Artificial Sequence
  Description of Artificial Sequence: Synthetic polypeptide
EEDRKDFLKNLPKSTVNGVSWTNETQRQKSHTFNCRMLMK

SEQ ID NO: 4360 - protein, 40 aa, Artificial Sequence
  Description of Artificial Sequence: Synthetic polypeptide
DRKDFLKNLPKSTVNGVSWTNETQRQKSHTFNCRMLMKTP

SEQ ID NO: 4361 - protein, 40 aa, Artificial Sequence
  Description of Artificial Sequence: Synthetic polypeptide
DFLKNLPKSTVNGVSWTNETQRQKSHTFNCRMLMKTPHDI

SEQ ID NO: 4362 - protein, 40 aa, Artificial Sequence
  Description of Artificial Sequence: Synthetic polypeptide
FLKNLPKSTVNGVSWTNETQRQKSHTFNCRMLMKTPHDIL

SEQ ID NO: 4363 - protein, 40 aa, Artificial Sequence
  Description of Artificial Sequence: Synthetic polypeptide
STVNGVSWTNETQRQKSHTFNCRMLMKTPHDILEDINASP

SEQ ID NO: 4364 - protein, 40 aa, Artificial Sequence
  Description of Artificial Sequence: Synthetic polypeptide
HDLSGKVVNIDTNSLRSSMRPGFEDIIRRCIQRFFSLNDG

SEQ ID NO: 4365 - protein, 40 aa, Artificial Sequence
  Description of Artificial Sequence: Synthetic polypeptide
TSLLSTLSSPGPKLDNSPNMNITQPSKVSNQDSKSPLGFY

SEQ ID NO: 4366 - protein, 40 aa, Artificial Sequence
  Description of Artificial Sequence: Synthetic polypeptide
VSNQDSKSPLGFYCDQNPVESSMCQSNSRDHLSDKESKES

SEQ ID NO: 4367 - protein, 40 aa, Artificial Sequence
  Description of Artificial Sequence: Synthetic polypeptide
MCQSNSRDHLSDKESKESSVEGAENQRGPLESKGHKKLLQ

SEQ ID NO: 4368 - protein, 40 aa, Artificial Sequence
  Description of Artificial Sequence: Synthetic polypeptide
GVDNKMSQCTSSTIPSSSQEKDPKIKTETSEEGSGDLDNL

SEQ ID NO: 4369 - protein, 40 aa, Artificial Sequence
  Description of Artificial Sequence: Synthetic polypeptide
PKIKTETSEEGSGDLDNLDAILGDLTSSDFYNNSISSNGS

SEQ ID NO: 4370 - protein, 40 aa, Artificial Sequence
  Description of Artificial Sequence: Synthetic polypeptide
VSLDSPVSVGSSPPVKNISAFPMLPKQPMLGGNPRMMDSQ

SEQ ID NO: 4371 - protein, 40 aa, Artificial Sequence
  Description of Artificial Sequence: Synthetic polypeptide
FLNQSRQALELKMENPTAGGAAVMRPMMQPQVSSQQGFLN

SEQ ID NO: 4372 - protein, 40 aa, Artificial Sequence
  Description of Artificial Sequence: Synthetic polypeptide
SRQALELKMENPTAGGAAVMRPMMQPQVSSQQGFLNAQMV

SEQ ID NO: 4373 - protein, 40 aa, Artificial Sequence
  Description of Artificial Sequence: Synthetic polypeptide
PTAGGAAVMRPMMQPQVSSQQGFLNAQMVAQRSRELLSHH

SEQ ID NO: 4374 - protein, 40 aa, Artificial Sequence
  Description of Artificial Sequence: Synthetic polypeptide
TAGGAAVMRPMMQPQVSSQQGFLNAQMVAQRSRELLSHHF

SEQ ID NO: 4375 - protein, 40 aa, Artificial Sequence
  Description of Artificial Sequence: Synthetic polypeptide
AGGAAVMRPMMQPQVSSQQGFLNAQMVAQRSRELLSHHFR

SEQ ID NO: 4376 - protein, 40 aa, Artificial Sequence
  Description of Artificial Sequence: Synthetic polypeptide
GGAAVMRPMMQPQVSSQQGFLNAQMVAQRSRELLSHHFRQ

SEQ ID NO: 4377 - protein, 40 aa, Artificial Sequence
  Description of Artificial Sequence: Synthetic polypeptide
AVMRPMMQPQVSSQQGFLNAQMVAQRSRELLSHHFRQQRV

SEQ ID NO: 4378 - protein, 40 aa, Artificial Sequence
  Description of Artificial Sequence: Synthetic polypeptide
MQPQVSSQQGFLNAQMVAQRSRELLSHHFRQQRVAMMMQQ

SEQ ID NO: 4379 - protein, 40 aa, Artificial Sequence
  Description of Artificial Sequence: Synthetic polypeptide
QDMDLIDILWRQDIDLGVSREVFDFSQRRKEYELEKQKKL

SEQ ID NO: 4380 - protein, 40 aa, Artificial Sequence
  Description of Artificial Sequence: Synthetic polypeptide
QDIDLGVSREVFDFSQRRKEYELEKQKKLEKERQEQLQKE

SEQ ID NO: 4381 - protein, 40 aa, Artificial Sequence
  Description of Artificial Sequence: Synthetic polypeptide
DLGVSREVFDFSQRRKEYELEKQKKLEKERQEQLQKEQEK

SEQ ID NO: 4382 - protein, 40 aa, Artificial Sequence
  Description of Artificial Sequence: Synthetic polypeptide
SREVFDFSQRRKEYELEKQKKLEKERQEQLQKEQEKAFFA

SEQ ID NO: 4383 - protein, 40 aa, Artificial Sequence
  Description of Artificial Sequence: Synthetic polypeptide
REVFDFSQRRKEYELEKQKKLEKERQEQLQKEQEKAFFAQ

SEQ ID NO: 4384 - protein, 40 aa, Artificial Sequence
  Description of Artificial Sequence: Synthetic polypeptide
VFDFSQRRKEYELEKQKKLEKERQEQLQKEQEKAFFAQLQ

SEQ ID NO: 4385 - protein, 40 aa, Artificial Sequence
  Description of Artificial Sequence: Synthetic polypeptide
FDFSQRRKEYELEKQKKLEKERQEQLQKEQEKAFFAQLQL

SEQ ID NO: 4386 - protein, 40 aa, Artificial Sequence
  Description of Artificial Sequence: Synthetic polypeptide
DFSQRRKEYELEKQKKLEKERQEQLQKEQEKAFFAQLQLD

SEQ ID NO: 4387 - protein, 40 aa, Artificial Sequence
  Description of Artificial Sequence: Synthetic polypeptide
FSQRRKEYELEKQKKLEKERQEQLQKEQEKAFFAQLQLDE

SEQ ID NO: 4388 - protein, 40 aa, Artificial Sequence
  Description of Artificial Sequence: Synthetic polypeptide
SQRRKEYELEKQKKLEKERQEQLQKEQEKAFFAQLQLDEE

SEQ ID NO: 4389 - protein, 40 aa, Artificial Sequence
  Description of Artificial Sequence: Synthetic polypeptide
ELEKQKKLEKERQEQLQKEQEKAFFAQLQLDEETGEFLPI

SEQ ID NO: 4390 - protein, 40 aa, Artificial Sequence
  Description of Artificial Sequence: Synthetic polypeptide
MEKQKKLEKERQEQLQKEQEKAFFAQLQLDEETGEFLPIQ

SEQ ID NO: 4391 - protein, 40 aa, Artificial Sequence
  Description of Artificial Sequence: Synthetic polypeptide
EKQKKLEKERQEQLQKEQEKAFFAQLQLDEETGEFLPIQP

SEQ ID NO: 4392 - protein, 40 aa, Artificial Sequence
  Description of Artificial Sequence: Synthetic polypeptide
DKLVETTMVPSPEAKLTEVDNYHFYSSIPSMEKEVGNCSP

SEQ ID NO: 4393 - protein, 40 aa, Artificial Sequence
  Description of Artificial Sequence: Synthetic polypeptide
MVETTMVPSPEAKLTEVDNYHFYSSIPSMEKEVGNCSPHF

SEQ ID NO: 4394 - protein, 40 aa, Artificial Sequence
  Description of Artificial Sequence: Synthetic polypeptide
ETTMVPSPEAKLTEVDNYHFYSSIPSMEKEVGNCSPHFLN

SEQ ID NO: 4395 - protein, 40 aa, Artificial Sequence
  Description of Artificial Sequence: Synthetic polypeptide
TTMVPSPEAKLTEVDNYHFYSSIPSMEKEVGNCSPHFLNA

SEQ ID NO: 4396 - protein, 40 aa, Artificial Sequence
  Description of Artificial Sequence: Synthetic polypeptide
TMVPSPEAKLTEVDNYHFYSSIPSMEKEVGNCSPHFLNAF

SEQ ID NO: 4397 - protein, 40 aa, Artificial Sequence
  Description of Artificial Sequence: Synthetic polypeptide
VPSPEAKLTEVDNYHFYSSIPSMEKEVGNCSPHFLNAFED

SEQ ID NO: 4398 - protein, 40 aa, Artificial Sequence
  Description of Artificial Sequence: Synthetic polypeptide
PSPEAKLTEVDNYHFYSSIPSMEKEVGNCSPHFLNAFEDS

SEQ ID NO: 4399 - protein, 40 aa, Artificial Sequence
  Description of Artificial Sequence: Synthetic polypeptide
SPEAKLTEVDNYHFYSSIPSMEKEVGNCSPHFLNAFEDSF

SEQ ID NO: 4400 - protein, 40 aa, Artificial Sequence
  Description of Artificial Sequence: Synthetic polypeptide
PEAKLTEVDNYHFYSSIPSMEKEVGNCSPHFLNAFEDSFS

SEQ ID NO: 4401 - protein, 40 aa, Artificial Sequence
  Description of Artificial Sequence: Synthetic polypeptide
EAKLTEVDNYHFYSSIPSMEKEVGNCSPHFLNAFEDSFSS

SEQ ID NO: 4402 - protein, 40 aa, Artificial Sequence
  Description of Artificial Sequence: Synthetic polypeptide
AKLTEVDNYHFYSSIPSMEKEVGNCSPHFLNAFEDSFSSI

SEQ ID NO: 4403 - protein, 40 aa, Artificial Sequence
  Description of Artificial Sequence: Synthetic polypeptide
KLTEVDNYHFYSSIPSMEKEVGNCSPHFLNAFEDSFSSIL

SEQ ID NO: 4404 - protein, 40 aa, Artificial Sequence
  Description of Artificial Sequence: Synthetic polypeptide
MTEVDNYHFYSSIPSMEKEVGNCSPHFLNAFEDSFSSILS

SEQ ID NO: 4405 - protein, 40 aa, Artificial Sequence
  Description of Artificial Sequence: Synthetic polypeptide
TEVDNYHFYSSIPSMEKEVGNCSPHFLNAFEDSFSSILST

SEQ ID NO: 4406 - protein, 40 aa, Artificial Sequence
  Description of Artificial Sequence: Synthetic polypeptide
EVDNYHFYSSIPSMEKEVGNCSPHFLNAFEDSFSSILSTE

SEQ ID NO: 4407 - protein, 40 aa, Artificial Sequence
  Description of Artificial Sequence: Synthetic polypeptide
NYHFYSSIPSMEKEVGNCSPHFLNAFEDSFSSILSTEDPN

SEQ ID NO: 4408 - protein, 40 aa, Artificial Sequence
  Description of Artificial Sequence: Synthetic polypeptide
HFYSSIPSMEKEVGNCSPHFLNAFEDSFSSILSTEDPNQL

SEQ ID NO: 4409 - protein, 40 aa, Artificial Sequence
  Description of Artificial Sequence: Synthetic polypeptide
NEMMSKEQFNEAQLALIRDIRRRGKNKVAAQNCRKRKLEN

SEQ ID NO: 4410 - protein, 40 aa, Artificial Sequence
  Description of Artificial Sequence: Synthetic polypeptide
KEQFNEAQLALIRDIRRRGKNKVAAQNCRKRKLENIVELE

SEQ ID NO: 4411 - protein, 40 aa, Artificial Sequence
  Description of Artificial Sequence: Synthetic polypeptide
EQFNEAQLALIRDIRRRGKNKVAAQNCRKRKLENIVELEQ

SEQ ID NO: 4412 - protein, 40 aa, Artificial Sequence
  Description of Artificial Sequence: Synthetic polypeptide
NEAQLALIRDIRRRGKNKVAAQNCRKRKLENIVELEQDLD

SEQ ID NO: 4413 - protein, 40 aa, Artificial Sequence
  Description of Artificial Sequence: Synthetic polypeptide
EAQLALIRDIRRRGKNKVAAQNCRKRKLENIVELEQDLDH

SEQ ID NO: 4414 - protein, 40 aa, Artificial Sequence
  Description of Artificial Sequence: Synthetic polypeptide
AQLALIRDIRRRGKNKVAAQNCRKRKLENIVELEQDLDHL

SEQ ID NO: 4415 - protein, 40 aa, Artificial Sequence
  Description of Artificial Sequence: Synthetic polypeptide
QLALIRDIRRRGKNKVAAQNCRKRKLENIVELEQDLDHLK

SEQ ID NO: 4416 - protein, 40 aa, Artificial Sequence
  Description of Artificial Sequence: Synthetic polypeptide
ALIRDIRRRGKNKVAAQNCRKRKLENIVELEQDLDHLKDE

SEQ ID NO: 4417 - protein, 40 aa, Artificial Sequence
  Description of Artificial Sequence: Synthetic polypeptide
LIRDIRRRGKNKVAAQNCRKRKLENIVELEQDLDHLKDEK

SEQ ID NO: 4418 - protein, 40 aa, Artificial Sequence
  Description of Artificial Sequence: Synthetic polypeptide
DIRRRGKNKVAAQNCRKRKLENIVELEQDLDHLKDEKEKL

SEQ ID NO: 4419 - protein, 40 aa, Artificial Sequence
  Description of Artificial Sequence: Synthetic polypeptide
RRGKNKVAAQNCRKRKLENIVELEQDLDHLKDEKEKLLKE

SEQ ID NO: 4420 - protein, 40 aa, Artificial Sequence
  Description of Artificial Sequence: Synthetic polypeptide
GKNKVAAQNCRKRKLENIVELEQDLDHLKDEKEKLLKEKG

SEQ ID NO: 4421 - protein, 40 aa, Artificial Sequence
  Description of Artificial Sequence: Synthetic polypeptide
NKVAAQNCRKRKLENIVELEQDLDHLKDEKEKLLKEKGEN

SEQ ID NO: 4422 - protein, 40 aa, Artificial Sequence
  Description of Artificial Sequence: Synthetic polypeptide
AAQNCRKRKLENIVELEQDLDHLKDEKEKLLKEKGENDKS

SEQ ID NO: 4423 - protein, 40 aa, Artificial Sequence
  Description of Artificial Sequence: Synthetic polypeptide
QNCRKRKLENIVELEQDLDHLKDEKEKLLKEKGENDKSLH

SEQ ID NO: 4424 - protein, 40 aa, Artificial Sequence
  Description of Artificial Sequence: Synthetic polypeptide
MENIVELEQDLDHLKDEKEKLLKEKGENDKSLHLLKKQLS

SEQ ID NO: 4425 - protein, 40 aa, Artificial Sequence
  Description of Artificial Sequence: Synthetic polypeptide
ENIVELEQDLDHLKDEKEKLLKEKGENDKSLHLLKKQLST

SEQ ID NO: 4426 - protein, 40 aa, Artificial Sequence
  Description of Artificial Sequence: Synthetic polypeptide
IVELEQDLDHLKDEKEKLLKEKGENDKSLHLLKKQLSTLY

SEQ ID NO: 4427 - protein, 40 aa, Artificial Sequence
  Description of Artificial Sequence: Synthetic polypeptide
LEQDLDHLKDEKEKLLKEKGENDKSLHLLKKQLSTLYLEV

SEQ ID NO: 4428 - protein, 40 aa, Artificial Sequence
  Description of Artificial Sequence: Synthetic polypeptide
MLKEKGENDKSLHLLKKQLSTLYLEVFSMLRDEDGKPYSP

SEQ ID NO: 4429 - protein, 40 aa, Artificial Sequence
  Description of Artificial Sequence: Synthetic polypeptide
LKEKGENDKSLHLLKKQLSTLYLEVFSMLRDEDGKPYSPS

SEQ ID NO: 4430 - protein, 40 aa, Artificial Sequence
  Description of Artificial Sequence: Synthetic polypeptide
KEKGENDKSLHLLKKQLSTLYLEVFSMLRDEDGKPYSPSE

SEQ ID NO: 4431 - protein, 40 aa, Artificial Sequence
  Description of Artificial Sequence: Synthetic polypeptide
VVPVLVRDGQPCGGGGGGEVGTAAAQEKCGAPPAAACPLP

SEQ ID NO: 4432 - protein, 40 aa, Artificial Sequence
  Description of Artificial Sequence: Synthetic polypeptide
VRDGQPCGGGGGGEVGTAAAQEKCGAPPAAACPLPGYPAF

SEQ ID NO: 4433 - protein, 40 aa, Artificial Sequence
  Description of Artificial Sequence: Synthetic polypeptide
RDGQPCGGGGGGEVGTAAAQEKCGAPPAAACPLPGYPAFG

SEQ ID NO: 4434 - protein, 40 aa, Artificial Sequence
  Description of Artificial Sequence: Synthetic polypeptide
GGGGGEVGTAAAQEKCGAPPAAACPLPGYPAFGPGSALGL

SEQ ID NO: 4435 - protein, 40 aa, Artificial Sequence
  Description of Artificial Sequence: Synthetic polypeptide
GGGGEVGTAAAQEKCGAPPAAACPLPGYPAFGPGSALGLF

SEQ ID NO: 4436 - protein, 40 aa, Artificial Sequence
  Description of Artificial Sequence: Synthetic polypeptide
LCLALLPALAARGPRCSQPGETCLNGGKCEAANGTEACVC

SEQ ID NO: 4437 - protein, 40 aa, Artificial Sequence
  Description of Artificial Sequence: Synthetic polypeptide
VDTKQAHELAKSYGIPFIETSAKTRQGVEDAFYTLVREIR

SEQ ID NO: 4438 - protein, 40 aa, Artificial Sequence
  Description of Artificial Sequence: Synthetic polypeptide
TKQAHELAKSYGIPFIETSAKTRQGVEDAFYTLVREIRQY

SEQ ID NO: 4439 - protein, 40 aa, Artificial Sequence
  Description of Artificial Sequence: Synthetic polypeptide
KQAHELAKSYGIPFIETSAKTRQGVEDAFYTLVREIRQYR

SEQ ID NO: 4440 - protein, 40 aa, Artificial Sequence
  Description of Artificial Sequence: Synthetic polypeptide
AHELAKSYGIPFIETSAKTRQGVEDAFYTLVREIRQYRMK

SEQ ID NO: 4441 - protein, 40 aa, Artificial Sequence
  Description of Artificial Sequence: Synthetic polypeptide
HELAKSYGIPFIETSAKTRQGVEDAFYTLVREIRQYRMKK

SEQ ID NO: 4442 - protein, 40 aa, Artificial Sequence
  Description of Artificial Sequence: Synthetic polypeptide
ELAKSYGIPFIETSAKTRQGVEDAFYTLVREIRQYRMKKL

SEQ ID NO: 4443 - protein, 40 aa, Artificial Sequence
  Description of Artificial Sequence: Synthetic polypeptide
KSYGIPFIETSAKTRQGVEDAFYTLVREIRQYRMKKLNSS

SEQ ID NO: 4444 - protein, 40 aa, Artificial Sequence
  Description of Artificial Sequence: Synthetic polypeptide
IETSAKTRQGVEDAFYTLVREIRQYRMKKLNSSDDGTQGC

SEQ ID NO: 4445 - protein, 40 aa, Artificial Sequence
  Description of Artificial Sequence: Synthetic polypeptide
RDQIPELENNEKAPKVVILKKATAYILSVQAETQKLISEI

SEQ ID NO: 4446 - protein, 40 aa, Artificial Sequence
  Description of Artificial Sequence: Synthetic polypeptide
MENNEKAPKVVILKKATAYILSVQAETQKLISEIDLLRKQ

SEQ ID NO: 4447 - protein, 40 aa, Artificial Sequence
  Description of Artificial Sequence: Synthetic polypeptide
ENNEKAPKVVILKKATAYILSVQAETQKLISEIDLLRKQN

SEQ ID NO: 4448 - protein, 40 aa, Artificial Sequence
  Description of Artificial Sequence: Synthetic polypeptide
PSSGELWGIHLMPPRILVECLLPNGMIVTLECLREATLIT

SEQ ID NO: 4449 - protein, 40 aa, Artificial Sequence
  Description of Artificial Sequence: Synthetic polypeptide
TLECLREATLITIKHELFKEARKYPLHQLLQDESSYIFVS

SEQ ID NO: 4450 - protein, 40 aa, Artificial Sequence
  Description of Artificial Sequence: Synthetic polypeptide
LECLREATLITIKHELFKEARKYPLHQLLQDESSYIFVSV

SEQ ID NO: 4451 - protein, 40 aa, Artificial Sequence
  Description of Artificial Sequence: Synthetic polypeptide
ECLREATLITIKHELFKEARKYPLHQLLQDESSYIFVSVT

SEQ ID NO: 4452 - protein, 40 aa, Artificial Sequence
  Description of Artificial Sequence: Synthetic polypeptide
CLREATLITIKHELFKEARKYPLHQLLQDESSYIFVSVTQ

SEQ ID NO: 4453 - protein, 40 aa, Artificial Sequence
  Description of Artificial Sequence: Synthetic polypeptide
EATLITIKHELFKEARKYPLHQLLQDESSYIFVSVTQEAE

SEQ ID NO: 4454 - protein, 40 aa, Artificial Sequence
  Description of Artificial Sequence: Synthetic polypeptide
LITIKHELFKEARKYPLHQLLQDESSYIFVSVTQEAEREE

SEQ ID NO: 4455 - protein, 40 aa, Artificial Sequence
  Description of Artificial Sequence: Synthetic polypeptide
ITIKHELFKEARKYPLHQLLQDESSYIFVSVTQEAEREEF

SEQ ID NO: 4456 - protein, 40 aa, Artificial Sequence
  Description of Artificial Sequence: Synthetic polypeptide
TIKHELFKEARKYPLHQLLQDESSYIFVSVTQEAEREEFF

SEQ ID NO: 4457 - protein, 40 aa, Artificial Sequence
  Description of Artificial Sequence: Synthetic polypeptide
IKHELFKEARKYPLHQLLQDESSYIFVSVTQEAEREEFFD

SEQ ID NO: 4458 - protein, 40 aa, Artificial Sequence
  Description of Artificial Sequence: Synthetic polypeptide
KHELFKEARKYPLHQLLQDESSYIFVSVTQEAEREEFFDE

SEQ ID NO: 4459 - protein, 40 aa, Artificial Sequence
  Description of Artificial Sequence: Synthetic polypeptide
HELFKEARKYPLHQLLQDESSYIFVSVTQEAEREEFFDET

SEQ ID NO: 4460 - protein, 40 aa, Artificial Sequence
  Description of Artificial Sequence: Synthetic polypeptide
ELFKEARKYPLHQLLQDESSYIFVSVTQEAEREEFFDETR

SEQ ID NO: 4461 - protein, 40 aa, Artificial Sequence
  Description of Artificial Sequence: Synthetic polypeptide
KEARKYPLHQLLQDESSYIFVSVTQEAEREEFFDETRRLC

SEQ ID NO: 4462 - protein, 40 aa, Artificial Sequence
  Description of Artificial Sequence: Synthetic polypeptide
EARKYPLHQLLQDESSYIFVSVTQEAEREEFFDETRRLCD

SEQ ID NO: 4463 - protein, 40 aa, Artificial Sequence
  Description of Artificial Sequence: Synthetic polypeptide
KYPLHQLLQDESSYIFVSVTQEAEREEFFDETRRLCDLRL

SEQ ID NO: 4464 - protein, 40 aa, Artificial Sequence
  Description of Artificial Sequence: Synthetic polypeptide
YPLHQLLQDESSYIFVSVTQEAEREEFFDETRRLCDLRLF

SEQ ID NO: 4465 - protein, 40 aa, Artificial Sequence
  Description of Artificial Sequence: Synthetic polypeptide
HQLLQDESSYIFVSVTQEAEREEFFDETRRLCDLRLFQPF

SEQ ID NO: 4466 - protein, 40 aa, Artificial Sequence
  Description of Artificial Sequence: Synthetic polypeptide
QLLQDESSYIFVSVTQEAEREEFFDETRRLCDLRLFQPFL

SEQ ID NO: 4467 - protein, 40 aa, Artificial Sequence
  Description of Artificial Sequence: Synthetic polypeptide
LLQDESSYIFVSVTQEAEREEFFDETRRLCDLRLFQPFLK

SEQ ID NO: 4468 - protein, 40 aa, Artificial Sequence
  Description of Artificial Sequence: Synthetic polypeptide
LQDESSYIFVSVTQEAEREEFFDETRRLCDLRLFQPFLKV

SEQ ID NO: 4469 - protein, 40 aa, Artificial Sequence
  Description of Artificial Sequence: Synthetic polypeptide
QDESSYIFVSVTQEAEREEFFDETRRLCDLRLFQPFLKVI

SEQ ID NO: 4470 - protein, 40 aa, Artificial Sequence
  Description of Artificial Sequence: Synthetic polypeptide
DESSYIFVSVTQEAEREEFFDETRRLCDLRLFQPFLKVIE

SEQ ID NO: 4471 - protein, 40 aa, Artificial Sequence
  Description of Artificial Sequence: Synthetic polypeptide
ESSYIFVSVTQEAEREEFFDETRRLCDLRLFQPFLKVIEP

SEQ ID NO: 4472 - protein, 40 aa, Artificial Sequence
  Description of Artificial Sequence: Synthetic polypeptide
YIFVSVTQEAEREEFFDETRRLCDLRLFQPFLKVIEPVGN

SEQ ID NO: 4473 - protein, 40 aa, Artificial Sequence
  Description of Artificial Sequence: Synthetic polypeptide
TQEAEREEFFDETRRLCDLRLFQPFLKVIEPVGNREEKIL

SEQ ID NO: 4474 - protein, 40 aa, Artificial Sequence
  Description of Artificial Sequence: Synthetic polypeptide
EREEFFDETRRLCDLRLFQPFLKVIEPVGNREEKILNREI

SEQ ID NO: 4475 - protein, 40 aa, Artificial Sequence
  Description of Artificial Sequence: Synthetic polypeptide
EFFDETRRLCDLRLFQPFLKVIEPVGNREEKILNREIGFA

SEQ ID NO: 4476 - protein, 40 aa, Artificial Sequence
  Description of Artificial Sequence: Synthetic polypeptide
AIGMPVCEFDMVKDPEVQDFRRNILNVCKEAVDLRDLNSP

SEQ ID NO: 4477 - protein, 40 aa, Artificial Sequence
  Description of Artificial Sequence: Synthetic polypeptide
VCKEAVDLRDLNSPHSRAMYVYPPNVESSPELPKHIYNKL

SEQ ID NO: 4478 - protein, 40 aa, Artificial Sequence
  Description of Artificial Sequence: Synthetic polypeptide
KEAVDLRDLNSPHSRAMYVYPPNVESSPELPKHIYNKLDK

SEQ ID NO: 4479 - protein, 40 aa, Artificial Sequence
  Description of Artificial Sequence: Synthetic polypeptide
EAVDLRDLNSPHSRAMYVYPPNVESSPELPKHIYNKLDKG

SEQ ID NO: 4480 - protein, 40 aa, Artificial Sequence
  Description of Artificial Sequence: Synthetic polypeptide
AVDLRDLNSPHSRAMYVYPPNVESSPELPKHIYNKLDKGQ

SEQ ID NO: 4481 - protein, 40 aa, Artificial Sequence
  Description of Artificial Sequence: Synthetic polypeptide
VDLRDLNSPHSRAMYVYPPNVESSPELPKHIYNKLDKGQI

SEQ ID NO: 4482 - protein, 40 aa, Artificial Sequence
  Description of Artificial Sequence: Synthetic polypeptide
DLRDLNSPHSRAMYVYPPNVESSPELPKHIYNKLDKGQII

SEQ ID NO: 4483 - protein, 40 aa, Artificial Sequence
  Description of Artificial Sequence: Synthetic polypeptide
LRDLNSPHSRAMYVYPPNVESSPELPKHIYNKLDKGQIIV

SEQ ID NO: 4484 - protein, 40 aa, Artificial Sequence
  Description of Artificial Sequence: Synthetic polypeptide
LNSPHSRAMYVYPPNVESSPELPKHIYNKLDKGQIIVVIW

SEQ ID NO: 4485 - protein, 40 aa, Artificial Sequence
  Description of Artificial Sequence: Synthetic polypeptide
NSPHSRAMYVYPPNVESSPELPKHIYNKLDKGQIIVVIWV

SEQ ID NO: 4486 - protein, 40 aa, Artificial Sequence
  Description of Artificial Sequence: Synthetic polypeptide
SPHSRAMYVYPPNVESSPELPKHIYNKLDKGQIIVVIWVI

SEQ ID NO: 4487 - protein, 40 aa, Artificial Sequence
  Description of Artificial Sequence: Synthetic polypeptide
HSRAMYVYPPNVESSPELPKHIYNKLDKGQIIVVIWVIVS

SEQ ID NO: 4488 - protein, 40 aa, Artificial Sequence
  Description of Artificial Sequence: Synthetic polypeptide
AMYVYPPNVESSPELPKHIYNKLDKGQIIVVIWVIVSPNN

SEQ ID NO: 4489 - protein, 40 aa, Artificial Sequence
  Description of Artificial Sequence: Synthetic polypeptide
MYVYPPNVESSPELPKHIYNKLDKGQIIVVIWVIVSPNND

SEQ ID NO: 4490 - protein, 40 aa, Artificial Sequence
  Description of Artificial Sequence: Synthetic polypeptide
VYPPNVESSPELPKHIYNKLDKGQIIVVIWVIVSPNNDKQ

SEQ ID NO: 4491 - protein, 40 aa, Artificial Sequence
  Description of Artificial Sequence: Synthetic polypeptide
YPPNVESSPELPKHIYNKLDKGQIIVVIWVIVSPNNDKQK

SEQ ID NO: 4492 - protein, 40 aa, Artificial Sequence
  Description of Artificial Sequence: Synthetic polypeptide
PPNVESSPELPKHIYNKLDKGQIIVVIWVIVSPNNDKQKY

SEQ ID NO: 4493 - protein, 40 aa, Artificial Sequence
  Description of Artificial Sequence: Synthetic polypeptide
PNVESSPELPKHIYNKLDKGQIIVVIWVIVSPNNDKQKYT

SEQ ID NO: 4494 - protein, 40 aa, Artificial Sequence
  Description of Artificial Sequence: Synthetic polypeptide
VESSPELPKHIYNKLDKGQIIVVIWVIVSPNNDKQKYTLK

SEQ ID NO: 4495 - protein, 40 aa, Artificial Sequence
  Description of Artificial Sequence: Synthetic polypeptide
ESSPELPKHIYNKLDKGQIIVVIWVIVSPNNDKQKYTLKI

SEQ ID NO: 4496 - protein, 40 aa, Artificial Sequence
  Description of Artificial Sequence: Synthetic polypeptide
SSPELPKHIYNKLDKGQIIVVIWVIVSPNNDKQKYTLKIN

SEQ ID NO: 4497 - protein, 40 aa, Artificial Sequence
  Description of Artificial Sequence: Synthetic polypeptide
ELPKHIYNKLDKGQIIVVIWVIVSPNNDKQKYTLKINHDC

SEQ ID NO: 4498 - protein, 40 aa, Artificial Sequence
  Description of Artificial Sequence: Synthetic polypeptide
PKHIYNKLDKGQIIVVIWVIVSPNNDKQKYTLKINHDCVP

SEQ ID NO: 4499 - protein, 40 aa, Artificial Sequence
  Description of Artificial Sequence: Synthetic polypeptide
KHIYNKLDKGQIIVVIWVIVSPNNDKQKYTLKINHDCVPE

SEQ ID NO: 4500 - protein, 40 aa, Artificial Sequence
  Description of Artificial Sequence: Synthetic polypeptide
IYNKLDKGQIIVVIWVIVSPNNDKQKYTLKINHDCVPEQV

SEQ ID NO: 4501 - protein, 40 aa, Artificial Sequence
  Description of Artificial Sequence: Synthetic polypeptide
KGQIIVVIWVIVSPNNDKQKYTLKINHDCVPEQVIAEAIR

SEQ ID NO: 4502 - protein, 40 aa, Artificial Sequence
  Description of Artificial Sequence: Synthetic polypeptide
AIRKKTRSMLLSSEQLKLCVLEYQGKYILKVCGCDEYFLE

SEQ ID NO: 4503 - protein, 40 aa, Artificial Sequence
  Description of Artificial Sequence: Synthetic polypeptide
RKKTRSMLLSSEQLKLCVLEYQGKYILKVCGCDEYFLEKY

SEQ ID NO: 4504 - protein, 40 aa, Artificial Sequence
  Description of Artificial Sequence: Synthetic polypeptide
KTRSMLLSSEQLKLCVLEYQGKYILKVCGCDEYFLEKYPL

SEQ ID NO: 4505 - protein, 40 aa, Artificial Sequence
  Description of Artificial Sequence: Synthetic polypeptide
MLSSEQLKLCVLEYQGKYILKVCGCDEYFLEKYPLSQYKY

SEQ ID NO: 4506 - protein, 40 aa, Artificial Sequence
  Description of Artificial Sequence: Synthetic polypeptide
SSEQLKLCVLEYQGKYILKVCGCDEYFLEKYPLSQYKYIR

SEQ ID NO: 4507 - protein, 40 aa, Artificial Sequence
  Description of Artificial Sequence: Synthetic polypeptide
SEQLKLCVLEYQGKYILKVCGCDEYFLEKYPLSQYKYIRS

SEQ ID NO: 4508 - protein, 40 aa, Artificial Sequence
  Description of Artificial Sequence: Synthetic polypeptide
EQLKLCVLEYQGKYILKVCGCDEYFLEKYPLSQYKYIRSC

SEQ ID NO: 4509 - protein, 40 aa, Artificial Sequence
  Description of Artificial Sequence: Synthetic polypeptide
GKYILKVCGCDEYFLEKYPLSQYKYIRSCIMLGRMPNLML

SEQ ID NO: 4510 - protein, 40 aa, Artificial Sequence
  Description of Artificial Sequence: Synthetic polypeptide
CDEYFLEKYPLSQYKYIRSCIMLGRMPNLMLMAKESLYSQ

SEQ ID NO: 4511 - protein, 40 aa, Artificial Sequence
  Description of Artificial Sequence: Synthetic polypeptide
PMDCFTMPSYSRRISTATPYMNGETSTKSLWVINSALRIK

SEQ ID NO: 4512 - protein, 40 aa, Artificial Sequence
  Description of Artificial Sequence: Synthetic polypeptide
DCFTMPSYSRRISTATPYMNGETSTKSLWVINSALRIKIL

SEQ ID NO: 4513 - protein, 40 aa, Artificial Sequence
  Description of Artificial Sequence: Synthetic polypeptide
CFTMPSYSRRISTATPYMNGETSTKSLWVINSALRIKILC

SEQ ID NO: 4514 - protein, 40 aa, Artificial Sequence
  Description of Artificial Sequence: Synthetic polypeptide
PYMNGETSTKSLWVINSALRIKILCATYVNVNIRDIDKIY

SEQ ID NO: 4515 - protein, 40 aa, Artificial Sequence
  Description of Artificial Sequence: Synthetic polypeptide
STKSLWVINSALRIKILCATYVNVNIRDIDKIYVRTGIYH

SEQ ID NO: 4516 - protein, 40 aa, Artificial Sequence
  Description of Artificial Sequence: Synthetic polypeptide
NPNKETPCLELEFDWFSSVVKFPDMSVIEEHANWSVSREA

SEQ ID NO: 4517 - protein, 40 aa, Artificial Sequence
  Description of Artificial Sequence: Synthetic polypeptide
NKETPCLELEFDWFSSVVKFPDMSVIEEHANWSVSREAGF

SEQ ID NO: 4518 - protein, 40 aa, Artificial Sequence
  Description of Artificial Sequence: Synthetic polypeptide
ETPCLELEFDWFSSVVKFPDMSVIEEHANWSVSREAGFSY

SEQ ID NO: 4519 - protein, 40 aa, Artificial Sequence
  Description of Artificial Sequence: Synthetic polypeptide
AMELLDCNYPDPMVRGFAVRCLEKYLTDDKLSQYLIQLVQ

SEQ ID NO: 4520 - protein, 40 aa, Artificial Sequence
  Description of Artificial Sequence: Synthetic polypeptide
MELLDCNYPDPMVRGFAVRCLEKYLTDDKLSQYLIQLVQV

SEQ ID NO: 4521 - protein, 40 aa, Artificial Sequence
  Description of Artificial Sequence: Synthetic polypeptide
ELLDCNYPDPMVRGFAVRCLEKYLTDDKLSQYLIQLVQVL

SEQ ID NO: 4522 - protein, 40 aa, Artificial Sequence
  Description of Artificial Sequence: Synthetic polypeptide
LLDCNYPDPMVRGFAVRCLEKYLTDDKLSQYLIQLVQVLK

SEQ ID NO: 4523 - protein, 40 aa, Artificial Sequence
  Description of Artificial Sequence: Synthetic polypeptide
YPDPMVRGFAVRCLEKYLTDDKLSQYLIQLVQVLKYEQYL

SEQ ID NO: 4524 - protein, 40 aa, Artificial Sequence
  Description of Artificial Sequence: Synthetic polypeptide
VRGFAVRCLEKYLTDDKLSQYLIQLVQVLKYEQYLDNLLV

SEQ ID NO: 4525 - protein, 40 aa, Artificial Sequence
  Description of Artificial Sequence: Synthetic polypeptide
RGFAVRCLEKYLTDDKLSQYLIQLVQVLKYEQYLDNLLVR

SEQ ID NO: 4526 - protein, 40 aa, Artificial Sequence
  Description of Artificial Sequence: Synthetic polypeptide
FAVRCLEKYLTDDKLSQYLIQLVQVLKYEQYLDNLLVRFL

SEQ ID NO: 4527 - protein, 40 aa, Artificial Sequence
  Description of Artificial Sequence: Synthetic polypeptide
LTDDKLSQYLIQLVQVLKYEQYLDNLLVRFLLKKALTNQR

SEQ ID NO: 4528 - protein, 40 aa, Artificial Sequence
  Description of Artificial Sequence: Synthetic polypeptide
LIQLVQVLKYEQYLDNLLVRFLLKKALTNQRIGHFFFWHL

SEQ ID NO: 4529 - protein, 40 aa, Artificial Sequence
  Description of Artificial Sequence: Synthetic polypeptide
YLDNLLVRFLLKKALTNQRIGHFFFWHLKSEMHNKTVSQR

SEQ ID NO: 4530 - protein, 40 aa, Artificial Sequence
  Description of Artificial Sequence: Synthetic polypeptide
LVRFLLKKALTNQRIGHFFFWHLKSEMHNKTVSQRFGLLL

SEQ ID NO: 4531 - protein, 40 aa, Artificial Sequence
  Description of Artificial Sequence: Synthetic polypeptide
VRFLLKKALTNQRIGHFFFWHLKSEMHNKTVSQRFGLLLE

SEQ ID NO: 4532 - protein, 40 aa, Artificial Sequence
  Description of Artificial Sequence: Synthetic polypeptide
FLLKKALTNQRIGHFFFWHLKSEMHNKTVSQRFGLLLESY

SEQ ID NO: 4533 - protein, 40 aa, Artificial Sequence
  Description of Artificial Sequence: Synthetic polypeptide
LLKKALTNQRIGHFFFWHLKSEMHNKTVSQRFGLLLESYC

SEQ ID NO: 4534 - protein, 40 aa, Artificial Sequence
  Description of Artificial Sequence: Synthetic polypeptide
MKKALTNQRIGHFFFWHLKSEMHNKTVSQRFGLLLESYCR

SEQ ID NO: 4535 - protein, 40 aa, Artificial Sequence
  Description of Artificial Sequence: Synthetic polypeptide
KKALTNQRIGHFFFWHLKSEMHNKTVSQRFGLLLESYCRA

SEQ ID NO: 4536 - protein, 40 aa, Artificial Sequence
  Description of Artificial Sequence: Synthetic polypeptide
KALTNQRIGHFFFWHLKSEMHNKTVSQRFGLLLESYCRAC

SEQ ID NO: 4537 - protein, 40 aa, Artificial Sequence
  Description of Artificial Sequence: Synthetic polypeptide
ALTNQRIGHFFFWHLKSEMHNKTVSQRFGLLLESYCRACG

SEQ ID NO: 4538 - protein, 40 aa, Artificial Sequence
  Description of Artificial Sequence: Synthetic polypeptide
MTNQRIGHFFFWHLKSEMHNKTVSQRFGLLLESYCRACGM

SEQ ID NO: 4539 - protein, 40 aa, Artificial Sequence
  Description of Artificial Sequence: Synthetic polypeptide
TNQRIGHFFFWHLKSEMHNKTVSQRFGLLLESYCRACGMY

SEQ ID NO: 4540 - protein, 40 aa, Artificial Sequence
  Description of Artificial Sequence: Synthetic polypeptide
NQRIGHFFFWHLKSEMHNKTVSQRFGLLLESYCRACGMYL

SEQ ID NO: 4541 - protein, 40 aa, Artificial Sequence
  Description of Artificial Sequence: Synthetic polypeptide
FFWHLKSEMHNKTVSQRFGLLLESYCRACGMYLKHLNRQV

SEQ ID NO: 4542 - protein, 40 aa, Artificial Sequence
  Description of Artificial Sequence: Synthetic polypeptide
GMYLKHLNRQVEAMEKLINLTDILKQEKKDETQKVQMKFL

SEQ ID NO: 4543 - protein, 40 aa, Artificial Sequence
  Description of Artificial Sequence: Synthetic polypeptide
QVEAMEKLINLTDILKQEKKDETQKVQMKFLVEQMRRPDF

SEQ ID NO: 4544 - protein, 40 aa, Artificial Sequence
  Description of Artificial Sequence: Synthetic polypeptide
LINLTDILKQEKKDETQKVQMKFLVEQMRRPDFMDALQGF

SEQ ID NO: 4545 - protein, 40 aa, Artificial Sequence
  Description of Artificial Sequence: Synthetic polypeptide
INLTDILKQEKKDETQKVQMKFLVEQMRRPDFMDALQGFL

SEQ ID NO: 4546 - protein, 40 aa, Artificial Sequence
  Description of Artificial Sequence: Synthetic polypeptide
LTDILKQEKKDETQKVQMKFLVEQMRRPDFMDALQGFLSP

SEQ ID NO: 4547 - protein, 40 aa, Artificial Sequence
  Description of Artificial Sequence: Synthetic polypeptide
TDILKQEKKDETQKVQMKFLVEQMRRPDFMDALQGFLSPL

SEQ ID NO: 4548 - protein, 40 aa, Artificial Sequence
  Description of Artificial Sequence: Synthetic polypeptide
ILKQEKKDETQKVQMKFLVEQMRRPDFMDALQGFLSPLNP

SEQ ID NO: 4549 - protein, 40 aa, Artificial Sequence
  Description of Artificial Sequence: Synthetic polypeptide
KQEKKDETQKVQMKFLVEQMRRPDFMDALQGFLSPLNPAH

SEQ ID NO: 4550 - protein, 40 aa, Artificial Sequence
  Description of Artificial Sequence: Synthetic polypeptide
EKKDETQKVQMKFLVEQMRRPDFMDALQGFLSPLNPAHQL

SEQ ID NO: 4551 - protein, 40 aa, Artificial Sequence
  Description of Artificial Sequence: Synthetic polypeptide
KKDETQKVQMKFLVEQMRRPDFMDALQGFLSPLNPAHQLG

SEQ ID NO: 4552 - protein, 40 aa, Artificial Sequence
  Description of Artificial Sequence: Synthetic polypeptide
IRIMENIWQNQGLDLRMLPYGCLSIGDCVGLIEVVRNSHT

SEQ ID NO: 4553 - protein, 40 aa, Artificial Sequence
  Description of Artificial Sequence: Synthetic polypeptide
ENIWQNQGLDLRMLPYGCLSIGDCVGLIEVVRNSHTIMQI

SEQ ID NO: 4554 - protein, 40 aa, Artificial Sequence
  Description of Artificial Sequence: Synthetic polypeptide
WLKDKNKGEIYDAAIDLFTRSCAGYCVATFILGIGDRHNS

SEQ ID NO: 4555 - protein, 40 aa, Artificial Sequence
  Description of Artificial Sequence: Synthetic polypeptide
VKDDGQLFHIDFGHFLDHKKKKFGYKRERVPFVLTQDFLI

SEQ ID NO: 4556 - protein, 40 aa, Artificial Sequence
  Description of Artificial Sequence: Synthetic polypeptide
MFHIDFGHFLDHKKKKFGYKRERVPFVLTQDFLIVISKGA

SEQ ID NO: 4557 - protein, 40 aa, Artificial Sequence
  Description of Artificial Sequence: Synthetic polypeptide
DHKKKKFGYKRERVPFVLTQDFLIVISKGAQECTKTREFE

SEQ ID NO: 4558 - protein, 40 aa, Artificial Sequence
  Description of Artificial Sequence: Synthetic polypeptide
KKKFGYKRERVPFVLTQDFLIVISKGAQECTKTREFERFQ

SEQ ID NO: 4559 - protein, 40 aa, Artificial Sequence
  Description of Artificial Sequence: Synthetic polypeptide
KKFGYKRERVPFVLTQDFLIVISKGAQECTKTREFERFQE

SEQ ID NO: 4560 - protein, 40 aa, Artificial Sequence
  Description of Artificial Sequence: Synthetic polypeptide
ERVPFVLTQDFLIVISKGAQECTKTREFERFQEMCYKAYL

SEQ ID NO: 4561 - protein, 40 aa, Artificial Sequence
  Description of Artificial Sequence: Synthetic polypeptide
VLTQDFLIVISKGAQECTKTREFERFQEMCYKAYLAIRQH

SEQ ID NO: 4562 - protein, 40 aa, Artificial Sequence
  Description of Artificial Sequence: Synthetic polypeptide
QEMCYKAYLAIRQHANLFINLFSMMLGSGMPELQSFDDIA

SEQ ID NO: 4563 - protein, 40 aa, Artificial Sequence
  Description of Artificial Sequence: Synthetic polypeptide
ANLFINLFSMMLGSGMPELQSFDDIAYIRKTLALDKTEQE

SEQ ID NO: 4564 - protein, 40 aa, Artificial Sequence
  Description of Artificial Sequence: Synthetic polypeptide
LGSGMPELQSFDDIAYIRKTLALDKTEQEALEYFMKQMND

SEQ ID NO: 4565 - protein, 40 aa, Artificial Sequence
  Description of Artificial Sequence: Synthetic polypeptide
SGMPELQSFDDIAYIRKTLALDKTEQEALEYFMKQMNDAH

SEQ ID NO: 4566 - protein, 40 aa, Artificial Sequence
  Description of Artificial Sequence: Synthetic polypeptide
EVQSSEEYIQLLKKLIRSPSIPHQYWLTLQYLLKHFFKLS

SEQ ID NO: 4567 - protein, 40 aa, Artificial Sequence
  Description of Artificial Sequence: Synthetic polypeptide
LIRSPSIPHQYWLTLQYLLKHFFKLSQTSSKNLLNARVLS

SEQ ID NO: 4568 - protein, 40 aa, Artificial Sequence
  Description of Artificial Sequence: Synthetic polypeptide
FKLSQTSSKNLLNARVLSEIFSPMLFRFSAASSDNTENLI

SEQ ID NO: 4569 - protein, 40 aa, Artificial Sequence
  Description of Artificial Sequence: Synthetic polypeptide
SKNLLNARVLSEIFSPMLFRFSAASSDNTENLIKVIEILI

SEQ ID NO: 4570 - protein, 40 aa, Artificial Sequence
  Description of Artificial Sequence: Synthetic polypeptide
KNLLNARVLSEIFSPMLFRFSAASSDNTENLIKVIEILIS

SEQ ID NO: 4571 - protein, 40 aa, Artificial Sequence
  Description of Artificial Sequence: Synthetic polypeptide
NARVLSEIFSPMLFRFSAASSDNTENLIKVIEILISTEWN

SEQ ID NO: 4572 - protein, 40 aa, Artificial Sequence
  Description of Artificial Sequence: Synthetic polypeptide
ARVLSEIFSPMLFRFSAASSDNTENLIKVIEILISTEWNE

SEQ ID NO: 4573 - protein, 40 aa, Artificial Sequence
  Description of Artificial Sequence: Synthetic polypeptide
VLSEIFSPMLFRFSAASSDNTENLIKVIEILISTEWNERQ

SEQ ID NO: 4574 - protein, 40 aa, Artificial Sequence
  Description of Artificial Sequence: Synthetic polypeptide
NEKLRDTADGTFLVRDASTKMHGDYTLTLRKGGNNKLIKI

SEQ ID NO: 4575 - protein, 40 aa, Artificial Sequence
  Description of Artificial Sequence: Synthetic polypeptide
TLTLRKGGNNKLIKIFHRDGKYGFSDPLTFSSVVELINHY

SEQ ID NO: 4576 - protein, 40 aa, Artificial Sequence
  Description of Artificial Sequence: Synthetic polypeptide
KYGFSDPLTFSSVVELINHYRNESLAQYNPKLDVKLLYPV

SEQ ID NO: 4577 - protein, 40 aa, Artificial Sequence
  Description of Artificial Sequence: Synthetic polypeptide
RNESLAQYNPKLDVKLLYPVSKYQQDQVVKEDNIEAVGKK

SEQ ID NO: 4578 - protein, 40 aa, Artificial Sequence
  Description of Artificial Sequence: Synthetic polypeptide
ESLAQYNPKLDVKLLYPVSKYQQDQVVKEDNIEAVGKKLH

SEQ ID NO: 4579 - protein, 40 aa, Artificial Sequence
  Description of Artificial Sequence: Synthetic polypeptide
AQYNPKLDVKLLYPVSKYQQDQVVKEDNIEAVGKKLHEYN

SEQ ID NO: 4580 - protein, 40 aa, Artificial Sequence
  Description of Artificial Sequence: Synthetic polypeptide
MDVKLLYPVSKYQQDQVVKEDNIEAVGKKLHEYNTQFQEK

SEQ ID NO: 4581 - protein, 40 aa, Artificial Sequence
  Description of Artificial Sequence: Synthetic polypeptide
KLLYPVSKYQQDQVVKEDNIEAVGKKLHEYNTQFQEKSRE

SEQ ID NO: 4582 - protein, 40 aa, Artificial Sequence
  Description of Artificial Sequence: Synthetic polypeptide
LLYPVSKYQQDQVVKEDNIEAVGKKLHEYNTQFQEKSREY

SEQ ID NO: 4583 - protein, 40 aa, Artificial Sequence
  Description of Artificial Sequence: Synthetic polypeptide
PVSKYQQDQVVKEDNIEAVGKKLHEYNTQFQEKSREYDRL

SEQ ID NO: 4584 - protein, 40 aa, Artificial Sequence
  Description of Artificial Sequence: Synthetic polypeptide
QQDQVVKEDNIEAVGKKLHEYNTQFQEKSREYDRLYEEYT

SEQ ID NO: 4585 - protein, 40 aa, Artificial Sequence
  Description of Artificial Sequence: Synthetic polypeptide
QDQVVKEDNIEAVGKKLHEYNTQFQEKSREYDRLYEEYTR

SEQ ID NO: 4586 - protein, 40 aa, Artificial Sequence
  Description of Artificial Sequence: Synthetic polypeptide
DQVVKEDNIEAVGKKLHEYNTQFQEKSREYDRLYEEYTRT

SEQ ID NO: 4587 - protein, 40 aa, Artificial Sequence
  Description of Artificial Sequence: Synthetic polypeptide
QVVKEDNIEAVGKKLHEYNTQFQEKSREYDRLYEEYTRTS

SEQ ID NO: 4588 - protein, 40 aa, Artificial Sequence
  Description of Artificial Sequence: Synthetic polypeptide
VKEDNIEAVGKKLHEYNTQFQEKSREYDRLYEEYTRTSQE

SEQ ID NO: 4589 - protein, 40 aa, Artificial Sequence
  Description of Artificial Sequence: Synthetic polypeptide
KEDNIEAVGKKLHEYNTQFQEKSREYDRLYEEYTRTSQEI

SEQ ID NO: 4590 - protein, 40 aa, Artificial Sequence
  Description of Artificial Sequence: Synthetic polypeptide
EDNIEAVGKKLHEYNTQFQEKSREYDRLYEEYTRTSQEIQ

SEQ ID NO: 4591 - protein, 40 aa, Artificial Sequence
  Description of Artificial Sequence: Synthetic polypeptide
NIEAVGKKLHEYNTQFQEKSREYDRLYEEYTRTSQEIQMK

SEQ ID NO: 4592 - protein, 40 aa, Artificial Sequence
  Description of Artificial Sequence: Synthetic polypeptide
EAVGKKLHEYNTQFQEKSREYDRLYEEYTRTSQEIQMKRT

SEQ ID NO: 4593 - protein, 40 aa, Artificial Sequence
  Description of Artificial Sequence: Synthetic polypeptide
VGKKLHEYNTQFQEKSREYDRLYEEYTRTSQEIQMKRTAI

SEQ ID NO: 4594 - protein, 40 aa, Artificial Sequence
  Description of Artificial Sequence: Synthetic polypeptide
TSQEIQMKRTAIEAFNETIKIFEEQCQTQERYSKEYIEKF

SEQ ID NO: 4595 - protein, 40 aa, Artificial Sequence
  Description of Artificial Sequence: Synthetic polypeptide
SQEIQMKRTAIEAFNETIKIFEEQCQTQERYSKEYIEKFK

SEQ ID NO: 4596 - protein, 40 aa, Artificial Sequence
  Description of Artificial Sequence: Synthetic polypeptide
IQMKRTAIEAFNETIKIFEEQCQTQERYSKEYIEKFKREG

SEQ ID NO: 4597 - protein, 40 aa, Artificial Sequence
  Description of Artificial Sequence: Synthetic polypeptide
RTAIEAFNETIKIFEEQCQTQERYSKEYIEKFKREGNEKE

SEQ ID NO: 4598 - protein, 40 aa, Artificial Sequence
  Description of Artificial Sequence: Synthetic polypeptide
AIEAFNETIKIFEEQCQTQERYSKEYIEKFKREGNEKEIQ

SEQ ID NO: 4599 - protein, 40 aa, Artificial Sequence
  Description of Artificial Sequence: Synthetic polypeptide
AFNETIKIFEEQCQTQERYSKEYIEKFKREGNEKEIQRIM

SEQ ID NO: 4600 - protein, 40 aa, Artificial Sequence
  Description of Artificial Sequence: Synthetic polypeptide
NETIKIFEEQCQTQERYSKEYIEKFKREGNEKEIQRIMHN

SEQ ID NO: 4601 - protein, 40 aa, Artificial Sequence
  Description of Artificial Sequence: Synthetic polypeptide
TIKIFEEQCQTQERYSKEYIEKFKREGNEKEIQRIMHNYD

SEQ ID NO: 4602 - protein, 40 aa, Artificial Sequence
  Description of Artificial Sequence: Synthetic polypeptide
IKIFEEQCQTQERYSKEYIEKFKREGNEKEIQRIMHNYDK

SEQ ID NO: 4603 - protein, 40 aa, Artificial Sequence
  Description of Artificial Sequence: Synthetic polypeptide
KIFEEQCQTQERYSKEYIEKFKREGNEKEIQRIMHNYDKL

SEQ ID NO: 4604 - protein, 40 aa, Artificial Sequence
  Description of Artificial Sequence: Synthetic polypeptide
GNEKEIQRIMHNYDKLKSRISEIIDSRRRLEEDLKKQAAE

SEQ ID NO: 4605 - protein, 40 aa, Artificial Sequence
  Description of Artificial Sequence: Synthetic polypeptide
NEKEIQRIMHNYDKLKSRISEIIDSRRRLEEDLKKQAAEY

SEQ ID NO: 4606 - protein, 40 aa, Artificial Sequence
  Description of Artificial Sequence: Synthetic polypeptide
EIQRIMHNYDKLKSRISEIIDSRRRLEEDLKKQAAEYREI

SEQ ID NO: 4607 - protein, 40 aa, Artificial Sequence
  Description of Artificial Sequence: Synthetic polypeptide
MHNYDKLKSRISEIIDSRRRLEEDLKKQAAEYREIDKRMN

SEQ ID NO: 4608 - protein, 40 aa, Artificial Sequence
  Description of Artificial Sequence: Synthetic polypeptide
RRRLEEDLKKQAAEYREIDKRMNSIKPDLIQLRKTRDQYL

SEQ ID NO: 4609 - protein, 40 aa, Artificial Sequence
  Description of Artificial Sequence: Synthetic polypeptide
RRWFHPNITGVEAENLLLTRGVDGSFLARPSKSNPGDFTL

SEQ ID NO: 4610 - protein, 40 aa, Artificial Sequence
  Description of Artificial Sequence: Synthetic polypeptide
LSVRRNGAVTHIKIQNTGDYYDLYGGEKFATLAELVQYYM

SEQ ID NO: 4611 - protein, 40 aa, Artificial Sequence
  Description of Artificial Sequence: Synthetic polypeptide
ELKYPLNCADPTSERWFHGHLSGKEAEKLLTEKGKHGSFL

SEQ ID NO: 4612 - protein, 40 aa, Artificial Sequence
  Description of Artificial Sequence: Synthetic polypeptide
VGGGERFDSLTDLVEHYKKNPMVETLGTVLQLKQPLNTTR

SEQ ID NO: 4613 - protein, 40 aa, Artificial Sequence
  Description of Artificial Sequence: Synthetic polypeptide
RINAAEIESRVRELSKLAETTDKVKQGFWEEFETLQQQEC

SEQ ID NO: 4614 - protein, 40 aa, Artificial Sequence
  Description of Artificial Sequence: Synthetic polypeptide
INAAEIESRVRELSKLAETTDKVKQGFWEEFETLQQQECK

SEQ ID NO: 4615 - protein, 40 aa, Artificial Sequence
  Description of Artificial Sequence: Synthetic polypeptide
SKLAETTDKVKQGFWEEFETLQQQECKLLYSRKEGQRQEN

SEQ ID NO: 4616 - protein, 40 aa, Artificial Sequence
  Description of Artificial Sequence: Synthetic polypeptide
KQGFWEEFETLQQQECKLLYSRKEGQRQENKNKNRYKNIL

SEQ ID NO: 4617 - protein, 40 aa, Artificial Sequence
  Description of Artificial Sequence: Synthetic polypeptide
ETLQQQECKLLYSRKEGQRQENKNKNRYKNILPFDHTRVV

SEQ ID NO: 4618 - protein, 40 aa, Artificial Sequence
  Description of Artificial Sequence: Synthetic polypeptide
LQQQECKLLYSRKEGQRQENKNKNRYKNILPFDHTRVVLH

SEQ ID NO: 4619 - protein, 40 aa, Artificial Sequence
  Description of Artificial Sequence: Synthetic polypeptide
FWRMVFQENSRVIVMTTKEVERGKSKCVKYWPDEYALKEY

SEQ ID NO: 4620 - protein, 40 aa, Artificial Sequence
  Description of Artificial Sequence: Synthetic polypeptide
VFQENSRVIVMTTKEVERGKSKCVKYWPDEYALKEYGVMR

SEQ ID NO: 4621 - protein, 40 aa, Artificial Sequence
  Description of Artificial Sequence: Synthetic polypeptide
KSKCVKYWPDEYALKEYGVMRVRNVKESAAHDYTLRELKL

SEQ ID NO: 4622 - protein, 40 aa, Artificial Sequence
  Description of Artificial Sequence: Synthetic polypeptide
WPDEYALKEYGVMRVRNVKESAAHDYTLRELKLSKVGQGN

SEQ ID NO: 4623 - protein, 40 aa, Artificial Sequence
  Description of Artificial Sequence: Synthetic polypeptide
YALKEYGVMRVRNVKESAAHDYTLRELKLSKVGQGNTERT

SEQ ID NO: 4624 - protein, 40 aa, Artificial Sequence
  Description of Artificial Sequence: Synthetic polypeptide
RVRNVKESAAHDYTLRELKLSKVGQGNTERTVWQYHFRTW

SEQ ID NO: 4625 - protein, 40 aa, Artificial Sequence
  Description of Artificial Sequence: Synthetic polypeptide
HKQESIMDAGPVVVHCSAGIGRTGTFIVIDILIDIIREKG

SEQ ID NO: 4626 - protein, 40 aa, Artificial Sequence
  Description of Artificial Sequence: Synthetic polypeptide
RSQRSGMVQTEAQYRFIYMAVQHYIETLQRRIEEEQKSKR

SEQ ID NO: 4627 - protein, 40 aa, Artificial Sequence
  Description of Artificial Sequence: Synthetic polypeptide
ELAFETVLKEIFAKVSKQRQNSIRTNAITLGSAQAGQEPG

SEQ ID NO: 4628 - protein, 40 aa, Artificial Sequence
  Description of Artificial Sequence: Synthetic polypeptide
QAIKCVVVGDGAVGKTCLLISYTTNAFPGEYIPTVFDNYS

SEQ ID NO: 4629 - protein, 40 aa, Artificial Sequence
  Description of Artificial Sequence: Synthetic polypeptide
VMVDGKPVNLGLWDTAGQEDYDRLRPLSYPQTVGETYGKD

SEQ ID NO: 4630 - protein, 40 aa, Artificial Sequence
  Description of Artificial Sequence: Synthetic polypeptide
KPVNLGLWDTAGQEDYDRLRPLSYPQTVGETYGKDITSRG

SEQ ID NO: 4631 - protein, 40 aa, Artificial Sequence
  Description of Artificial Sequence: Synthetic polypeptide
NLGLWDTAGQEDYDRLRPLSYPQTVGETYGKDITSRGKDK

SEQ ID NO: 4632 - protein, 40 aa, Artificial Sequence
  Description of Artificial Sequence: Synthetic polypeptide
TAGQEDYDRLRPLSYPQTVGETYGKDITSRGKDKPIADVF

SEQ ID NO: 4633 - protein, 40 aa, Artificial Sequence
  Description of Artificial Sequence: Synthetic polypeptide
GQEDYDRLRPLSYPQTVGETYGKDITSRGKDKPIADVFLI

SEQ ID NO: 4634 - protein, 40 aa, Artificial Sequence
  Description of Artificial Sequence: Synthetic polypeptide
DYDRLRPLSYPQTVGETYGKDITSRGKDKPIADVFLICFS

SEQ ID NO: 4635 - protein, 40 aa, Artificial Sequence
  Description of Artificial Sequence: Synthetic polypeptide
RPLSYPQTVGETYGKDITSRGKDKPIADVFLICFSLVSPA

SEQ ID NO: 4636 - protein, 40 aa, Artificial Sequence
  Description of Artificial Sequence: Synthetic polypeptide
LSYPQTVGETYGKDITSRGKDKPIADVFLICFSLVSPASF

SEQ ID NO: 4637 - protein, 40 aa, Artificial Sequence
  Description of Artificial Sequence: Synthetic polypeptide
SYPQTVGETYGKDITSRGKDKPIADVFLICFSLVSPASFE

SEQ ID NO: 4638 - protein, 40 aa, Artificial Sequence
  Description of Artificial Sequence: Synthetic polypeptide
TVGETYGKDITSRGKDKPIADVFLICFSLVSPASFENVRA

SEQ ID NO: 4639 - protein, 40 aa, Artificial Sequence
  Description of Artificial Sequence: Synthetic polypeptide
TYGKDITSRGKDKPIADVFLICFSLVSPASFENVRAKWYP

SEQ ID NO: 4640 - protein, 40 aa, Artificial Sequence
  Description of Artificial Sequence: Synthetic polypeptide
KPIADVFLICFSLVSPASFENVRAKWYPEVRHHCPNTPII

SEQ ID NO: 4641 - protein, 40 aa, Artificial Sequence
  Description of Artificial Sequence: Synthetic polypeptide
SKTSNTIRVFLPNKQRTVVNVRNGMSLHDCLMKALKVRGL

SEQ ID NO: 4642 - protein, 40 aa, Artificial Sequence
  Description of Artificial Sequence: Synthetic polypeptide
VRNGMSLHDCLMKALKVRGLQPECCAVFRLLHEHKGKKAR

SEQ ID NO: 4643 - protein, 40 aa, Artificial Sequence
  Description of Artificial Sequence: Synthetic polypeptide
NGMSLHDCLMKALKVRGLQPECCAVFRLLHEHKGKKARLD

SEQ ID NO: 4644 - protein, 40 aa, Artificial Sequence
  Description of Artificial Sequence: Synthetic polypeptide
GMSLHDCLMKALKVRGLQPECCAVFRLLHEHKGKKARLDW

SEQ ID NO: 4645 - protein, 40 aa, Artificial Sequence
  Description of Artificial Sequence: Synthetic polypeptide
MSLHDCLMKALKVRGLQPECCAVFRLLHEHKGKKARLDWN

SEQ ID NO: 4646 - protein, 40 aa, Artificial Sequence
  Description of Artificial Sequence: Synthetic polypeptide
SLHDCLMKALKVRGLQPECCAVFRLLHEHKGKKARLDWNT

SEQ ID NO: 4647 - protein, 40 aa, Artificial Sequence
  Description of Artificial Sequence: Synthetic polypeptide
CLMKALKVRGLQPECCAVFRLLHEHKGKKARLDWNTDAAS

SEQ ID NO: 4648 - protein, 40 aa, Artificial Sequence
  Description of Artificial Sequence: Synthetic polypeptide
LKVRGLQPECCAVFRLLHEHKGKKARLDWNTDAASLIGEE

SEQ ID NO: 4649 - protein, 40 aa, Artificial Sequence
  Description of Artificial Sequence: Synthetic polypeptide
RGLQPECCAVFRLLHEHKGKKARLDWNTDAASLIGEELQV

SEQ ID NO: 4650 - protein, 40 aa, Artificial Sequence
  Description of Artificial Sequence: Synthetic polypeptide
QPECCAVFRLLHEHKGKKARLDWNTDAASLIGEELQVDFL

SEQ ID NO: 4651 - protein, 40 aa, Artificial Sequence
  Description of Artificial Sequence: Synthetic polypeptide
MFPNSTIGDSGVPALPSLTMRRMRESVSRMPVSSQHRYST

SEQ ID NO: 4652 - protein, 40 aa, Artificial Sequence
  Description of Artificial Sequence: Synthetic polypeptide
SSSPNNLSPTGWSQPKTPVPAQRERAPVSGTQEKNKIRPR

SEQ ID NO: 4653 - protein, 40 aa, Artificial Sequence
  Description of Artificial Sequence: Synthetic polypeptide
NRDQIIFMVGRGYASPDLSKLYKNCPKAMKRLVADCVKKV

SEQ ID NO: 4654 - protein, 40 aa, Artificial Sequence
  Description of Artificial Sequence: Synthetic polypeptide
SPDLSKLYKNCPKAMKRLVADCVKKVKEERPLFPQILSSI

SEQ ID NO: 4655 - protein, 40 aa, Artificial Sequence
  Description of Artificial Sequence: Synthetic polypeptide
IPLTAPPTNQWYHGKLDRTIAEERLRQAGKSGSYLIRESD

SEQ ID NO: 4656 - protein, 40 aa, Artificial Sequence
  Description of Artificial Sequence: Synthetic polypeptide
HGKLDRTIAEERLRQAGKSGSYLIRESDRRPGSFVLSFLS

SEQ ID NO: 4657 - protein, 40 aa, Artificial Sequence
  Description of Artificial Sequence: Synthetic polypeptide
DRTIAEERLRQAGKSGSYLIRESDRRPGSFVLSFLSQMNV

SEQ ID NO: 4658 - protein, 40 aa, Artificial Sequence
  Description of Artificial Sequence: Synthetic polypeptide
EERLRQAGKSGSYLIRESDRRPGSFVLSFLSQMNVVNHFR

SEQ ID NO: 4659 - protein, 40 aa, Artificial Sequence
  Description of Artificial Sequence: Synthetic polypeptide
RQAGKSGSYLIRESDRRPGSFVLSFLSQMNVVNHFRIIAM

SEQ ID NO: 4660 - protein, 40 aa, Artificial Sequence
  Description of Artificial Sequence: Synthetic polypeptide
AGKSGSYLIRESDRRPGSFVLSFLSQMNVVNHFRIIAMCG

SEQ ID NO: 4661 - protein, 40 aa, Artificial Sequence
  Description of Artificial Sequence: Synthetic polypeptide
SGSYLIRESDRRPGSFVLSFLSQMNVVNHFRIIAMCGDYY

SEQ ID NO: 4662 - protein, 40 aa, Artificial Sequence
  Description of Artificial Sequence: Synthetic polypeptide
YLIRESDRRPGSFVLSFLSQMNVVNHFRIIAMCGDYYIGG

SEQ ID NO: 4663 - protein, 40 aa, Artificial Sequence
  Description of Artificial Sequence: Synthetic polypeptide
LIRESDRRPGSFVLSFLSQMNVVNHFRIIAMCGDYYIGGR

SEQ ID NO: 4664 - protein, 40 aa, Artificial Sequence
  Description of Artificial Sequence: Synthetic polypeptide
ESDRRPGSFVLSFLSQMNVVNHFRIIAMCGDYYIGGRRFS

SEQ ID NO: 4665 - protein, 40 aa, Artificial Sequence
  Description of Artificial Sequence: Synthetic polypeptide
RRPGSFVLSFLSQMNVVNHFRIIAMCGDYYIGGRRFSSLS

SEQ ID NO: 4666 - protein, 40 aa, Artificial Sequence
  Description of Artificial Sequence: Synthetic polypeptide
RPGSFVLSFLSQMNVVNHFRIIAMCGDYYIGGRRFSSLSD

SEQ ID NO: 4667 - protein, 40 aa, Artificial Sequence
  Description of Artificial Sequence: Synthetic polypeptide
VLSFLSQMNVVNHFRIIAMCGDYYIGGRRFSSLSDLIGYY

SEQ ID NO: 4668 - protein, 40 aa, Artificial Sequence
  Description of Artificial Sequence: Synthetic polypeptide
NVVNHFRIIAMCGDYYIGGRRFSSLSDLIGYYSHVSCLLK

SEQ ID NO: 4669 - protein, 40 aa, Artificial Sequence
  Description of Artificial Sequence: Synthetic polypeptide
IIAMCGDYYIGGRRFSSLSDLIGYYSHVSCLLKGEKLLYP

SEQ ID NO: 4670 - protein, 40 aa, Artificial Sequence
  Description of Artificial Sequence: Synthetic polypeptide
IAMCGDYYIGGRRFSSLSDLIGYYSHVSCLLKGEKLLYPV

SEQ ID NO: 4671 - protein, 40 aa, Artificial Sequence
  Description of Artificial Sequence: Synthetic polypeptide
RRFSSLSDLIGYYSHVSCLLKGEKLLYPVAPPEPVEDRRR

SEQ ID NO: 4672 - protein, 40 aa, Artificial Sequence
  Description of Artificial Sequence: Synthetic polypeptide
RFSSLSDLIGYYSHVSCLLKGEKLLYPVAPPEPVEDRRRV

SEQ ID NO: 4673 - protein, 40 aa, Artificial Sequence
  Description of Artificial Sequence: Synthetic polypeptide
KIWFHGKISKQEAYNLLMTVGQVCSFLVRPSDNTPGDYSL

SEQ ID NO: 4674 - protein, 40 aa, Artificial Sequence
  Description of Artificial Sequence: Synthetic polypeptide
QRFKICPTPNNQFMMGGRYYNSIGDIIDHYRKEQIVEGYY

SEQ ID NO: 4675 - protein, 40 aa, Artificial Sequence
  Description of Artificial Sequence: Synthetic polypeptide
TPNNQFMMGGRYYNSIGDIIDHYRKEQIVEGYYLKEPVPM

SEQ ID NO: 4676 - protein, 40 aa, Artificial Sequence
  Description of Artificial Sequence: Synthetic polypeptide
NNQFMMGGRYYNSIGDIIDHYRKEQIVEGYYLKEPVPMQD

SEQ ID NO: 4677 - protein, 40 aa, Artificial Sequence
  Description of Artificial Sequence: Synthetic polypeptide
NQFMMGGRYYNSIGDIIDHYRKEQIVEGYYLKEPVPMQDQ

SEQ ID NO: 4678 - protein, 40 aa, Artificial Sequence
  Description of Artificial Sequence: Synthetic polypeptide
NDTVDGKEIYNTIRRKTKDAFYKNIVKKGYLLKKGKGKRW

SEQ ID NO: 4679 - protein, 40 aa, Artificial Sequence
  Description of Artificial Sequence: Synthetic polypeptide
TVDGKEIYNTIRRKTKDAFYKNIVKKGYLLKKGKGKRWKN

SEQ ID NO: 4680 - protein, 40 aa, Artificial Sequence
  Description of Artificial Sequence: Synthetic polypeptide
VDGKEIYNTIRRKTKDAFYKNIVKKGYLLKKGKGKRWKNL

SEQ ID NO: 4681 - protein, 40 aa, Artificial Sequence
  Description of Artificial Sequence: Synthetic polypeptide
DGKEIYNTIRRKTKDAFYKNIVKKGYLLKKGKGKRWKNLY

SEQ ID NO: 4682 - protein, 40 aa, Artificial Sequence
  Description of Artificial Sequence: Synthetic polypeptide
KEIYNTIRRKTKDAFYKNIVKKGYLLKKGKGKRWKNLYFI

SEQ ID NO: 4683 - protein, 40 aa, Artificial Sequence
  Description of Artificial Sequence: Synthetic polypeptide
IRRKTKDAFYKNIVKKGYLLKKGKGKRWKNLYFILEGSDA

SEQ ID NO: 4684 - protein, 40 aa, Artificial Sequence
  Description of Artificial Sequence: Synthetic polypeptide
RRKTKDAFYKNIVKKGYLLKKGKGKRWKNLYFILEGSDAQ

SEQ ID NO: 4685 - protein, 40 aa, Artificial Sequence
  Description of Artificial Sequence: Synthetic polypeptide
YKNIVKKGYLLKKGKGKRWKNLYFILEGSDAQLIYFESEK

SEQ ID NO: 4686 - protein, 40 aa, Artificial Sequence
  Description of Artificial Sequence: Synthetic polypeptide
IVKKGYLLKKGKGKRWKNLYFILEGSDAQLIYFESEKRAT

SEQ ID NO: 4687 - protein, 40 aa, Artificial Sequence
  Description of Artificial Sequence: Synthetic polypeptide
VKKGYLLKKGKGKRWKNLYFILEGSDAQLIYFESEKRATK

SEQ ID NO: 4688 - protein, 40 aa, Artificial Sequence
  Description of Artificial Sequence: Synthetic polypeptide
KGYLLKKGKGKRWKNLYFILEGSDAQLIYFESEKRATKPK

SEQ ID NO: 4689 - protein, 40 aa, Artificial Sequence
  Description of Artificial Sequence: Synthetic polypeptide
GYLLKKGKGKRWKNLYFILEGSDAQLIYFESEKRATKPKG

SEQ ID NO: 4690 - protein, 40 aa, Artificial Sequence
  Description of Artificial Sequence: Synthetic polypeptide
YLLKKGKGKRWKNLYFILEGSDAQLIYFESEKRATKPKGL

SEQ ID NO: 4691 - protein, 40 aa, Artificial Sequence
  Description of Artificial Sequence: Synthetic polypeptide
KGKGKRWKNLYFILEGSDAQLIYFESEKRATKPKGLIDLS

SEQ ID NO: 4692 - protein, 40 aa, Artificial Sequence
  Description of Artificial Sequence: Synthetic polypeptide
GKRWKNLYFILEGSDAQLIYFESEKRATKPKGLIDLSVCS

SEQ ID NO: 4693 - protein, 40 aa, Artificial Sequence
  Description of Artificial Sequence: Synthetic polypeptide
RWKNLYFILEGSDAQLIYFESEKRATKPKGLIDLSVCSVY

SEQ ID NO: 4694 - protein, 40 aa, Artificial Sequence
  Description of Artificial Sequence: Synthetic polypeptide
WKNLYFILEGSDAQLIYFESEKRATKPKGLIDLSVCSVYV

SEQ ID NO: 4695 - protein, 40 aa, Artificial Sequence
  Description of Artificial Sequence: Synthetic polypeptide
KNLYFILEGSDAQLIYFESEKRATKPKGLIDLSVCSVYVV

SEQ ID NO: 4696 - protein, 40 aa, Artificial Sequence
  Description of Artificial Sequence: Synthetic polypeptide
NLYFILEGSDAQLIYFESEKRATKPKGLIDLSVCSVYVVH

SEQ ID NO: 4697 - protein, 40 aa, Artificial Sequence
  Description of Artificial Sequence: Synthetic polypeptide
AQLIYFESEKRATKPKGLIDLSVCSVYVVHDSLFGRPNCF

SEQ ID NO: 4698 - protein, 40 aa, Artificial Sequence
  Description of Artificial Sequence: Synthetic polypeptide
LSVCSVYVVHDSLFGRPNCFQIVVQHFSEEHYIFYFAGET

SEQ ID NO: 4699 - protein, 40 aa, Artificial Sequence
  Description of Artificial Sequence: Synthetic polypeptide
PEQAEDWMKGLQAFCNLRKSSPGTSNKRLRQVSSLVLHIE

SEQ ID NO: 4700 - protein, 40 aa, Artificial Sequence
  Description of Artificial Sequence: Synthetic polypeptide
AEDWMKGLQAFCNLRKSSPGTSNKRLRQVSSLVLHIEEAH

SEQ ID NO: 4701 - protein, 40 aa, Artificial Sequence
  Description of Artificial Sequence: Synthetic polypeptide
MKGLQAFCNLRKSSPGTSNKRLRQVSSLVLHIEEAHKLPV

SEQ ID NO: 4702 - protein, 40 aa, Artificial Sequence
  Description of Artificial Sequence: Synthetic polypeptide
GLQAFCNLRKSSPGTSNKRLRQVSSLVLHIEEAHKLPVKH

SEQ ID NO: 4703 - protein, 40 aa, Artificial Sequence
  Description of Artificial Sequence: Synthetic polypeptide
AFCNLRKSSPGTSNKRLRQVSSLVLHIEEAHKLPVKHFTN

SEQ ID NO: 4704 - protein, 40 aa, Artificial Sequence
  Description of Artificial Sequence: Synthetic polypeptide
FCNLRKSSPGTSNKRLRQVSSLVLHIEEAHKLPVKHFTNP

SEQ ID NO: 4705 - protein, 40 aa, Artificial Sequence
  Description of Artificial Sequence: Synthetic polypeptide
CNLRKSSPGTSNKRLRQVSSLVLHIEEAHKLPVKHFTNPY

SEQ ID NO: 4706 - protein, 40 aa, Artificial Sequence
  Description of Artificial Sequence: Synthetic polypeptide
NLRKSSPGTSNKRLRQVSSLVLHIEEAHKLPVKHFTNPYC

SEQ ID NO: 4707 - protein, 40 aa, Artificial Sequence
  Description of Artificial Sequence: Synthetic polypeptide
RKSSPGTSNKRLRQVSSLVLHIEEAHKLPVKHFTNPYCNI

SEQ ID NO: 4708 - protein, 40 aa, Artificial Sequence
  Description of Artificial Sequence: Synthetic polypeptide
SSPGTSNKRLRQVSSLVLHIEEAHKLPVKHFTNPYCNIYL

SEQ ID NO: 4709 - protein, 40 aa, Artificial Sequence
  Description of Artificial Sequence: Synthetic polypeptide
SPGTSNKRLRQVSSLVLHIEEAHKLPVKHFTNPYCNIYLN

SEQ ID NO: 4710 - protein, 40 aa, Artificial Sequence
  Description of Artificial Sequence: Synthetic polypeptide
GTSNKRLRQVSSLVLHIEEAHKLPVKHFTNPYCNIYLNSV

SEQ ID NO: 4711 - protein, 40 aa, Artificial Sequence
  Description of Artificial Sequence: Synthetic polypeptide
TSNKRLRQVSSLVLHIEEAHKLPVKHFTNPYCNIYLNSVQ

SEQ ID NO: 4712 - protein, 40 aa, Artificial Sequence
  Description of Artificial Sequence: Synthetic polypeptide
SNKRLRQVSSLVLHIEEAHKLPVKHFTNPYCNIYLNSVQV

SEQ ID NO: 4713 - protein, 40 aa, Artificial Sequence
  Description of Artificial Sequence: Synthetic polypeptide
NKRLRQVSSLVLHIEEAHKLPVKHFTNPYCNIYLNSVQVA

SEQ ID NO: 4714 - protein, 40 aa, Artificial Sequence
  Description of Artificial Sequence: Synthetic polypeptide
RLRQVSSLVLHIEEAHKLPVKHFTNPYCNIYLNSVQVAKT

SEQ ID NO: 4715 - protein, 40 aa, Artificial Sequence
  Description of Artificial Sequence: Synthetic polypeptide
LRQVSSLVLHIEEAHKLPVKHFTNPYCNIYLNSVQVAKTH

SEQ ID NO: 4716 - protein, 40 aa, Artificial Sequence
  Description of Artificial Sequence: Synthetic polypeptide
VLHIEEAHKLPVKHFTNPYCNIYLNSVQVAKTHAREGQNP

SEQ ID NO: 4717 - protein, 40 aa, Artificial Sequence
  Description of Artificial Sequence: Synthetic polypeptide
PVWSEEFVFDDLPPDINRFEITLSNKTKKSKDPDILFMRC

SEQ ID NO: 4718 - protein, 40 aa, Artificial Sequence
  Description of Artificial Sequence: Synthetic polypeptide
VWSEEFVFDDLPPDINRFEITLSNKTKKSKDPDILFMRCQ

SEQ ID NO: 4719 - protein, 40 aa, Artificial Sequence
  Description of Artificial Sequence: Synthetic polypeptide
WSEEFVFDDLPPDINRFEITLSNKTKKSKDPDILFMRCQL

SEQ ID NO: 4720 - protein, 40 aa, Artificial Sequence
  Description of Artificial Sequence: Synthetic polypeptide
DDLPPDINRFEITLSNKTKKSKDPDILFMRCQLSRLQKGH

SEQ ID NO: 4721 - protein, 40 aa, Artificial Sequence
  Description of Artificial Sequence: Synthetic polypeptide
DLPPDINRFEITLSNKTKKSKDPDILFMRCQLSRLQKGHA

SEQ ID NO: 4722 - protein, 40 aa, Artificial Sequence
  Description of Artificial Sequence: Synthetic polypeptide
PPDINRFEITLSNKTKKSKDPDILFMRCQLSRLQKGHATD

SEQ ID NO: 4723 - protein, 40 aa, Artificial Sequence
  Description of Artificial Sequence: Synthetic polypeptide
PDINRFEITLSNKTKKSKDPDILFMRCQLSRLQKGHATDE

SEQ ID NO: 4724 - protein, 40 aa, Artificial Sequence
  Description of Artificial Sequence: Synthetic polypeptide
DINRFEITLSNKTKKSKDPDILFMRCQLSRLQKGHATDEW

SEQ ID NO: 4725 - protein, 40 aa, Artificial Sequence
  Description of Artificial Sequence: Synthetic polypeptide
FEITLSNKTKKSKDPDILFMRCQLSRLQKGHATDEWFLLS

SEQ ID NO: 4726 - protein, 40 aa, Artificial Sequence
  Description of Artificial Sequence: Synthetic polypeptide
HATDEWFLLSSHIPLKGIEPGSLRVRARYSMEKIMPEEEY

SEQ ID NO: 4727 - protein, 40 aa, Artificial Sequence
  Description of Artificial Sequence: Synthetic polypeptide
SSHIPLKGIEPGSLRVRARYSMEKIMPEEEYSEFKELILQ

SEQ ID NO: 4728 - protein, 40 aa, Artificial Sequence
  Description of Artificial Sequence: Synthetic polypeptide
HIPLKGIEPGSLRVRARYSMEKIMPEEEYSEFKELILQKE

SEQ ID NO: 4729 - protein, 40 aa, Artificial Sequence
  Description of Artificial Sequence: Synthetic polypeptide
LKGIEPGSLRVRARYSMEKIMPEEEYSEFKELILQKELHV

SEQ ID NO: 4730 - protein, 40 aa, Artificial Sequence
  Description of Artificial Sequence: Synthetic polypeptide
EPGSLRVRARYSMEKIMPEEEYSEFKELILQKELHVVYAL

SEQ ID NO: 4731 - protein, 40 aa, Artificial Sequence
  Description of Artificial Sequence: Synthetic polypeptide
YSEFKELILQKELHVVYALSHVCGQDRTLLASILLRIFLH

SEQ ID NO: 4732 - protein, 40 aa, Artificial Sequence
  Description of Artificial Sequence: Synthetic polypeptide
VCGQDRTLLASILLRIFLHEKLESLLLCTLNDREISMEDE

SEQ ID NO: 4733 - protein, 40 aa, Artificial Sequence
  Description of Artificial Sequence: Synthetic polypeptide
TTLASTLMEQYMKATATQFVHHALKDSILKIMESKQSCEL

SEQ ID NO: 4734 - protein, 40 aa, Artificial Sequence
  Description of Artificial Sequence: Synthetic polypeptide
MEQYMKATATQFVHHALKDSILKIMESKQSCELSPSKLEK

SEQ ID NO: 4735 - protein, 40 aa, Artificial Sequence
  Description of Artificial Sequence: Synthetic polypeptide
ILKIMESKQSCELSPSKLEKNEDVNTNLTHLLNILSELVE

SEQ ID NO: 4736 - protein, 40 aa, Artificial Sequence
  Description of Artificial Sequence: Synthetic polypeptide
VNTNLTHLLNILSELVEKIFMASEILPPTLRYIYGCLQKS

SEQ ID NO: 4737 - protein, 40 aa, Artificial Sequence
  Description of Artificial Sequence: Synthetic polypeptide
PTLRYIYGCLQKSVQHKWPTNTTMRTRVVSGFVFLRLICP

SEQ ID NO: 4738 - protein, 40 aa, Artificial Sequence
  Description of Artificial Sequence: Synthetic polypeptide
MIMFLDELGNVPELPDTTEHSRTDLSRDLAALHEICVAHS

SEQ ID NO: 4739 - protein, 40 aa, Artificial Sequence
  Description of Artificial Sequence: Synthetic polypeptide
KIPDHVRERAWLTWEKVSSVDGVLGGYIQKKKELWGICIF

SEQ ID NO: 4740 - protein, 40 aa, Artificial Sequence
  Description of Artificial Sequence: Synthetic polypeptide
ERAWLTWEKVSSVDGVLGGYIQKKKELWGICIFIAAVDLD

SEQ ID NO: 4741 - protein, 40 aa, Artificial Sequence
  Description of Artificial Sequence: Synthetic polypeptide
AWLTWEKVSSVDGVLGGYIQKKKELWGICIFIAAVDLDEM

SEQ ID NO: 4742 - protein, 40 aa, Artificial Sequence
  Description of Artificial Sequence: Synthetic polypeptide
LTWEKVSSVDGVLGGYIQKKKELWGICIFIAAVDLDEMSF

SEQ ID NO: 4743 - protein, 40 aa, Artificial Sequence
  Description of Artificial Sequence: Synthetic polypeptide
VLGGYIQKKKELWGICIFIAAVDLDEMSFTFTELQKNIEI

SEQ ID NO: 4744 - protein, 40 aa, Artificial Sequence
  Description of Artificial Sequence: Synthetic polypeptide
GGYIQKKKELWGICIFIAAVDLDEMSFTFTELQKNIEISV

SEQ ID NO: 4745 - protein, 40 aa, Artificial Sequence
  Description of Artificial Sequence: Synthetic polypeptide
GYIQKKKELWGICIFIAAVDLDEMSFTFTELQKNIEISVH

SEQ ID NO: 4746 - protein, 40 aa, Artificial Sequence
  Description of Artificial Sequence: Synthetic polypeptide
YIQKKKELWGICIFIAAVDLDEMSFTFTELQKNIEISVHK

SEQ ID NO: 4747 - protein, 40 aa, Artificial Sequence
  Description of Artificial Sequence: Synthetic polypeptide
IQKKKELWGICIFIAAVDLDEMSFTFTELQKNIEISVHKF

SEQ ID NO: 4748 - protein, 40 aa, Artificial Sequence
  Description of Artificial Sequence: Synthetic polypeptide
ELWGICIFIAAVDLDEMSFTFTELQKNIEISVHKFFNLLK

SEQ ID NO: 4749 - protein, 40 aa, Artificial Sequence
  Description of Artificial Sequence: Synthetic polypeptide
CIFIAAVDLDEMSFTFTELQKNIEISVHKFFNLLKEIDTS

SEQ ID NO: 4750 - protein, 40 aa, Artificial Sequence
  Description of Artificial Sequence: Synthetic polypeptide
IFIAAVDLDEMSFTFTELQKNIEISVHKFFNLLKEIDTST

SEQ ID NO: 4751 - protein, 40 aa, Artificial Sequence
  Description of Artificial Sequence: Synthetic polypeptide
LFSKLERTCELIYLTQPSSSISTEINSALVLKVSWITFLL

SEQ ID NO: 4752 - protein, 40 aa, Artificial Sequence
  Description of Artificial Sequence: Synthetic polypeptide
ERTCELIYLTQPSSSISTEINSALVLKVSWITFLLAKGEV

SEQ ID NO: 4753 - protein, 40 aa, Artificial Sequence
  Description of Artificial Sequence: Synthetic polypeptide
ELIYLTQPSSSISTEINSALVLKVSWITFLLAKGEVLQME

SEQ ID NO: 4754 - protein, 40 aa, Artificial Sequence
  Description of Artificial Sequence: Synthetic polypeptide
LIYLTQPSSSISTEINSALVLKVSWITFLLAKGEVLQMED

SEQ ID NO: 4755 - protein, 40 aa, Artificial Sequence
  Description of Artificial Sequence: Synthetic polypeptide
IYLTQPSSSISTEINSALVLKVSWITFLLAKGEVLQMEDD

SEQ ID NO: 4756 - protein, 40 aa, Artificial Sequence
  Description of Artificial Sequence: Synthetic polypeptide
YLTQPSSSISTEINSALVLKVSWITFLLAKGEVLQMEDDL

SEQ ID NO: 4757 - protein, 40 aa, Artificial Sequence
  Description of Artificial Sequence: Synthetic polypeptide
SISTEINSALVLKVSWITFLLAKGEVLQMEDDLVISFQLM

SEQ ID NO: 4758 - protein, 40 aa, Artificial Sequence
  Description of Artificial Sequence: Synthetic polypeptide
STEINSALVLKVSWITFLLAKGEVLQMEDDLVISFQLMLC

SEQ ID NO: 4759 - protein, 40 aa, Artificial Sequence
  Description of Artificial Sequence: Synthetic polypeptide
ALVLKVSWITFLLAKGEVLQMEDDLVISFQLMLCVLDYFI

SEQ ID NO: 4760 - protein, 40 aa, Artificial Sequence
  Description of Artificial Sequence: Synthetic polypeptide
LKVSWITFLLAKGEVLQMEDDLVISFQLMLCVLDYFIKLS

SEQ ID NO: 4761 - protein, 40 aa, Artificial Sequence
  Description of Artificial Sequence: Synthetic polypeptide
KVSWITFLLAKGEVLQMEDDLVISFQLMLCVLDYFIKLSP

SEQ ID NO: 4762 - protein, 40 aa, Artificial Sequence
  Description of Artificial Sequence: Synthetic polypeptide
LQMEDDLVISFQLMLCVLDYFIKLSPPMLLKEPYKTAVIP

SEQ ID NO: 4763 - protein, 40 aa, Artificial Sequence
  Description of Artificial Sequence: Synthetic polypeptide
EDDLVISFQLMLCVLDYFIKLSPPMLLKEPYKTAVIPING

SEQ ID NO: 4764 - protein, 40 aa, Artificial Sequence
  Description of Artificial Sequence: Synthetic polypeptide
NRSARIAKQLENDTRIIEVLCKEHECNIDEVKNVYFKNFI

SEQ ID NO: 4765 - protein, 40 aa, Artificial Sequence
  Description of Artificial Sequence: Synthetic polypeptide
RSARIAKQLENDTRIIEVLCKEHECNIDEVKNVYFKNFIP

SEQ ID NO: 4766 - protein, 40 aa, Artificial Sequence
  Description of Artificial Sequence: Synthetic polypeptide
SARIAKQLENDTRIIEVLCKEHECNIDEVKNVYFKNFIPF

SEQ ID NO: 4767 - protein, 40 aa, Artificial Sequence
  Description of Artificial Sequence: Synthetic polypeptide
IAKQLENDTRIIEVLCKEHECNIDEVKNVYFKNFIPFMNS

SEQ ID NO: 4768 - protein, 40 aa, Artificial Sequence
  Description of Artificial Sequence: Synthetic polypeptide
LENDTRIIEVLCKEHECNIDEVKNVYFKNFIPFMNSLGLV

SEQ ID NO: 4769 - protein, 40 aa, Artificial Sequence
  Description of Artificial Sequence: Synthetic polypeptide
ENDTRIIEVLCKEHECNIDEVKNVYFKNFIPFMNSLGLVT

SEQ ID NO: 4770 - protein, 40 aa, Artificial Sequence
  Description of Artificial Sequence: Synthetic polypeptide
DTRIIEVLCKEHECNIDEVKNVYFKNFIPFMNSLGLVTSN

SEQ ID NO: 4771 - protein, 40 aa, Artificial Sequence
  Description of Artificial Sequence: Synthetic polypeptide
TRIIEVLCKEHECNIDEVKNVYFKNFIPFMNSLGLVTSNG

SEQ ID NO: 4772 - protein, 40 aa, Artificial Sequence
  Description of Artificial Sequence: Synthetic polypeptide
IEVLCKEHECNIDEVKNVYFKNFIPFMNSLGLVTSNGLPE

SEQ ID NO: 4773 - protein, 40 aa, Artificial Sequence
  Description of Artificial Sequence: Synthetic polypeptide
EVLCKEHECNIDEVKNVYFKNFIPFMNSLGLVTSNGLPEV

SEQ ID NO: 4774 - protein, 40 aa, Artificial Sequence
  Description of Artificial Sequence: Synthetic polypeptide
CNIDEVKNVYFKNFIPFMNSLGLVTSNGLPEVENLSKRYE

SEQ ID NO: 4775 - protein, 40 aa, Artificial Sequence
  Description of Artificial Sequence: Synthetic polypeptide
VKNVYFKNFIPFMNSLGLVTSNGLPEVENLSKRYEEIYLK

SEQ ID NO: 4776 - protein, 40 aa, Artificial Sequence
  Description of Artificial Sequence: Synthetic polypeptide
KNVYFKNFIPFMNSLGLVTSNGLPEVENLSKRYEEIYLKN

SEQ ID NO: 4777 - protein, 40 aa, Artificial Sequence
  Description of Artificial Sequence: Synthetic polypeptide
NVYFKNFIPFMNSLGLVTSNGLPEVENLSKRYEEIYLKNK

SEQ ID NO: 4778 - protein, 40 aa, Artificial Sequence
  Description of Artificial Sequence: Synthetic polypeptide
VYFKNFIPFMNSLGLVTSNGLPEVENLSKRYEEIYLKNKD

SEQ ID NO: 4779 - protein, 40 aa, Artificial Sequence
  Description of Artificial Sequence: Synthetic polypeptide
PFMNSLGLVTSNGLPEVENLSKRYEEIYLKNKDLDARLFL

SEQ ID NO: 4780 - protein, 40 aa, Artificial Sequence
  Description of Artificial Sequence: Synthetic polypeptide
MNSLGLVTSNGLPEVENLSKRYEEIYLKNKDLDARLFLDH

SEQ ID NO: 4781 - protein, 40 aa, Artificial Sequence
  Description of Artificial Sequence: Synthetic polypeptide
VTSNGLPEVENLSKRYEEIYLKNKDLDARLFLDHDKTLQT

SEQ ID NO: 4782 - protein, 40 aa, Artificial Sequence
  Description of Artificial Sequence: Synthetic polypeptide
TSNGLPEVENLSKRYEEIYLKNKDLDARLFLDHDKTLQTD

SEQ ID NO: 4783 - protein, 40 aa, Artificial Sequence
  Description of Artificial Sequence: Synthetic polypeptide
SNGLPEVENLSKRYEEIYLKNKDLDARLFLDHDKTLQTDS

SEQ ID NO: 4784 - protein, 40 aa, Artificial Sequence
  Description of Artificial Sequence: Synthetic polypeptide
GLPEVENLSKRYEEIYLKNKDLDARLFLDHDKTLQTDSID

SEQ ID NO: 4785 - protein, 40 aa, Artificial Sequence
  Description of Artificial Sequence: Synthetic polypeptide
LPEVENLSKRYEEIYLKNKDLDARLFLDHDKTLQTDSIDS

SEQ ID NO: 4786 - protein, 40 aa, Artificial Sequence
  Description of Artificial Sequence: Synthetic polypeptide
PEVENLSKRYEEIYLKNKDLDARLFLDHDKTLQTDSIDSF

SEQ ID NO: 4787 - protein, 40 aa, Artificial Sequence
  Description of Artificial Sequence: Synthetic polypeptide
EVENLSKRYEEIYLKNKDLDARLFLDHDKTLQTDSIDSFE

SEQ ID NO: 4788 - protein, 40 aa, Artificial Sequence
  Description of Artificial Sequence: Synthetic polypeptide
VENLSKRYEEIYLKNKDLDARLFLDHDKTLQTDSIDSFET

SEQ ID NO: 4789 - protein, 40 aa, Artificial Sequence
  Description of Artificial Sequence: Synthetic polypeptide
NLSKRYEEIYLKNKDLDARLFLDHDKTLQTDSIDSFETQR

SEQ ID NO: 4790 - protein, 40 aa, Artificial Sequence
  Description of Artificial Sequence: Synthetic polypeptide
LSKRYEEIYLKNKDLDARLFLDHDKTLQTDSIDSFETQRT

SEQ ID NO: 4791 - protein, 40 aa, Artificial Sequence
  Description of Artificial Sequence: Synthetic polypeptide
SKRYEEIYLKNKDLDARLFLDHDKTLQTDSIDSFETQRTP

SEQ ID NO: 4792 - protein, 40 aa, Artificial Sequence
  Description of Artificial Sequence: Synthetic polypeptide
KRYEEIYLKNKDLDARLFLDHDKTLQTDSIDSFETQRTPR

SEQ ID NO: 4793 - protein, 40 aa, Artificial Sequence
  Description of Artificial Sequence: Synthetic polypeptide
RYEEIYLKNKDLDARLFLDHDKTLQTDSIDSFETQRTPRK

SEQ ID NO: 4794 - protein, 40 aa, Artificial Sequence
  Description of Artificial Sequence: Synthetic polypeptide
LMMILNSASDQPSENLISYFNNCTVNPKESILKRVKDIGY

SEQ ID NO: 4795 - protein, 40 aa, Artificial Sequence
  Description of Artificial Sequence: Synthetic polypeptide
PSENLISYFNNCTVNPKESILKRVKDIGYIFKEKFAKAVG

SEQ ID NO: 4796 - protein, 40 aa, Artificial Sequence
  Description of Artificial Sequence: Synthetic polypeptide
IGYIFKEKFAKAVGQGCVEIGSQRYKLGVRLYYRVMESML

SEQ ID NO: 4797 - protein, 40 aa, Artificial Sequence
  Description of Artificial Sequence: Synthetic polypeptide
IFKEKFAKAVGQGCVEIGSQRYKLGVRLYYRVMESMLKSE

SEQ ID NO: 4798 - protein, 40 aa, Artificial Sequence
  Description of Artificial Sequence: Synthetic polypeptide
SLLACALEVVMATYSRSTSQNLDSGTDLSFPWILNVLNLK

SEQ ID NO: 4799 - protein, 40 aa, Artificial Sequence
  Description of Artificial Sequence: Synthetic polypeptide
CALEVVMATYSRSTSQNLDSGTDLSFPWILNVLNLKAFDF

SEQ ID NO: 4800 - protein, 40 aa, Artificial Sequence
  Description of Artificial Sequence: Synthetic polypeptide
RSTSQNLDSGTDLSFPWILNVLNLKAFDFYKVIESFIKAE

SEQ ID NO: 4801 - protein, 40 aa, Artificial Sequence
  Description of Artificial Sequence: Synthetic polypeptide
STSQNLDSGTDLSFPWILNVLNLKAFDFYKVIESFIKAEG

SEQ ID NO: 4802 - protein, 40 aa, Artificial Sequence
  Description of Artificial Sequence: Synthetic polypeptide
NLDSGTDLSFPWILNVLNLKAFDFYKVIESFIKAEGNLTR

SEQ ID NO: 4803 - protein, 40 aa, Artificial Sequence
  Description of Artificial Sequence: Synthetic polypeptide
TDLSFPWILNVLNLKAFDFYKVIESFIKAEGNLTREMIKH

SEQ ID NO: 4804 - protein, 40 aa, Artificial Sequence
  Description of Artificial Sequence: Synthetic polypeptide
MSFPWILNVLNLKAFDFYKVIESFIKAEGNLTREMIKHLE

SEQ ID NO: 4805 - protein, 40 aa, Artificial Sequence
  Description of Artificial Sequence: Synthetic polypeptide
SFPWILNVLNLKAFDFYKVIESFIKAEGNLTREMIKHLER

SEQ ID NO: 4806 - protein, 40 aa, Artificial Sequence
  Description of Artificial Sequence: Synthetic polypeptide
FPWILNVLNLKAFDFYKVIESFIKAEGNLTREMIKHLERC

SEQ ID NO: 4807 - protein, 40 aa, Artificial Sequence
  Description of Artificial Sequence: Synthetic polypeptide
PWILNVLNLKAFDFYKVIESFIKAEGNLTREMIKHLERCE

SEQ ID NO: 4808 - protein, 40 aa, Artificial Sequence
  Description of Artificial Sequence: Synthetic polypeptide
ILNVLNLKAFDFYKVIESFIKAEGNLTREMIKHLERCEHR

SEQ ID NO: 4809 - protein, 40 aa, Artificial Sequence
  Description of Artificial Sequence: Synthetic polypeptide
NVLNLKAFDFYKVIESFIKAEGNLTREMIKHLERCEHRIM

SEQ ID NO: 4810 - protein, 40 aa, Artificial Sequence
  Description of Artificial Sequence: Synthetic polypeptide
VLNLKAFDFYKVIESFIKAEGNLTREMIKHLERCEHRIME

SEQ ID NO: 4811 - protein, 40 aa, Artificial Sequence
  Description of Artificial Sequence: Synthetic polypeptide
LNLKAFDFYKVIESFIKAEGNLTREMIKHLERCEHRIMES

SEQ ID NO: 4812 - protein, 40 aa, Artificial Sequence
  Description of Artificial Sequence: Synthetic polypeptide
NLKAFDFYKVIESFIKAEGNLTREMIKHLERCEHRIMESL

SEQ ID NO: 4813 - protein, 40 aa, Artificial Sequence
  Description of Artificial Sequence: Synthetic polypeptide
PLKSTSLSLFYKKVYRLAYLRLNTLCERLLSEHPELEHII

SEQ ID NO: 4814 - protein, 40 aa, Artificial Sequence
  Description of Artificial Sequence: Synthetic polypeptide
KDLPHAVQETFKRVLIKEEEYDSIIVFYNSVFMQRLKTNI

SEQ ID NO: 4815 - protein, 40 aa, Artificial Sequence
  Description of Artificial Sequence: Synthetic polypeptide
DLPHAVQETFKRVLIKEEEYDSIIVFYNSVFMQRLKTNIL

SEQ ID NO: 4816 - protein, 40 aa, Artificial Sequence
  Description of Artificial Sequence: Synthetic polypeptide
AVQETFKRVLIKEEEYDSIIVFYNSVFMQRLKTNILQYAS

SEQ ID NO: 4817 - protein, 40 aa, Artificial Sequence
  Description of Artificial Sequence: Synthetic polypeptide
TRPPTLSPIPHIPRSPYKFPSSPLRIPGGNIYISPLKSPY

SEQ ID NO: 4818 - protein, 40 aa, Artificial Sequence
  Description of Artificial Sequence: Synthetic polypeptide
PTPTKMTPRSRILVSIGESFGTSEKFQKINQMVCNSDRVL

SEQ ID NO: 4819 - protein, 40 aa, Artificial Sequence
  Description of Artificial Sequence: Synthetic polypeptide
TPTKMTPRSRILVSIGESFGTSEKFQKINQMVCNSDRVLK

SEQ ID NO: 4820 - protein, 40 aa, Artificial Sequence
  Description of Artificial Sequence: Synthetic polypeptide
TKMTPRSRILVSIGESFGTSEKFQKINQMVCNSDRVLKRS

SEQ ID NO: 4821 - protein, 40 aa, Artificial Sequence
  Description of Artificial Sequence: Synthetic polypeptide
SEKFQKINQMVCNSDRVLKRSAEGSNPPKPLKKLRFDIEG

SEQ ID NO: 4822 - protein, 40 aa, Artificial Sequence
  Description of Artificial Sequence: Synthetic polypeptide
NSDRVLKRSAEGSNPPKPLKKLRFDIEGSDEADGSKHLPG

SEQ ID NO: 4823 - protein, 40 aa, Artificial Sequence
  Description of Artificial Sequence: Synthetic polypeptide
EGSNPPKPLKKLRFDIEGSDEADGSKHLPGESKFQQKLAE

SEQ ID NO: 4824 - protein, 40 aa, Artificial Sequence
  Description of Artificial Sequence: Synthetic polypeptide
TAGQDEYSIFPQTYSIDINGYILVYSVTSIKSFEVIKVIH

SEQ ID NO: 4825 - protein, 40 aa, Artificial Sequence
  Description of Artificial Sequence: Synthetic polypeptide
QDEYSIFPQTYSIDINGYILVYSVTSIKSFEVIKVIHGKL

SEQ ID NO: 4826 - protein, 40 aa, Artificial Sequence
  Description of Artificial Sequence: Synthetic polypeptide
LVYSVTSIKSFEVIKVIHGKLLDMVGKVQIPIMLVGNKKD

SEQ ID NO: 4827 - protein, 40 aa, Artificial Sequence
  Description of Artificial Sequence: Synthetic polypeptide
TSIKSFEVIKVIHGKLLDMVGKVQIPIMLVGNKKDLHMER

SEQ ID NO: 4828 - protein, 40 aa, Artificial Sequence
  Description of Artificial Sequence: Synthetic polypeptide
MHMERVISYEEGKALAESWNAAFLESSAKENQTAVDVFRR

SEQ ID NO: 4829 - protein, 40 aa, Artificial Sequence
  Description of Artificial Sequence: Synthetic polypeptide
AAFLESSAKENQTAVDVFRRIILEAEKMDGAASQGKSSCS

SEQ ID NO: 4830 - protein, 40 aa, Artificial Sequence
  Description of Artificial Sequence: Synthetic polypeptide
CLLIVFSKDQFPEVYVPTVFENYVADIEVDGKQVELALWD

SEQ ID NO: 4831 - protein, 40 aa, Artificial Sequence
  Description of Artificial Sequence: Synthetic polypeptide
SKDQFPEVYVPTVFENYVADIEVDGKQVELALWDTAGQED

SEQ ID NO: 4832 - protein, 40 aa, Artificial Sequence
  Description of Artificial Sequence: Synthetic polypeptide
KWTPEVKHFCPNVPIILVGNKKDLRNDEHTRRELAKMKQE

SEQ ID NO: 4833 - protein, 40 aa, Artificial Sequence
  Description of Artificial Sequence: Synthetic polypeptide
NVPIILVGNKKDLRNDEHTRRELAKMKQEPVKPEEGRDMA

SEQ ID NO: 4834 - protein, 40 aa, Artificial Sequence
  Description of Artificial Sequence: Synthetic polypeptide
RTGEGFLLVFSVTDRGSFEEIYKFQRQILRVKDRDEFPMI

SEQ ID NO: 4835 - protein, 40 aa, Artificial Sequence
  Description of Artificial Sequence: Synthetic polypeptide
GEGFLLVFSVTDRGSFEEIYKFQRQILRVKDRDEFPMILI

SEQ ID NO: 4836 - protein, 40 aa, Artificial Sequence
  Description of Artificial Sequence: Synthetic polypeptide
EEIYKFQRQILRVKDRDEFPMILIGNKADLDHQRQVTQEE

SEQ ID NO: 4837 - protein, 40 aa, Artificial Sequence
  Description of Artificial Sequence: Synthetic polypeptide
EIYKFQRQILRVKDRDEFPMILIGNKADLDHQRQVTQEEG

SEQ ID NO: 4838 - protein, 40 aa, Artificial Sequence
  Description of Artificial Sequence: Synthetic polypeptide
IYKFQRQILRVKDRDEFPMILIGNKADLDHQRQVTQEEGQ

SEQ ID NO: 4839 - protein, 40 aa, Artificial Sequence
  Description of Artificial Sequence: Synthetic polypeptide
QRQILRVKDRDEFPMILIGNKADLDHQRQVTQEEGQQLAR

SEQ ID NO: 4840 - protein, 40 aa, Artificial Sequence
  Description of Artificial Sequence: Synthetic polypeptide
ILRVKDRDEFPMILIGNKADLDHQRQVTQEEGQQLARQLK

SEQ ID NO: 4841 - protein, 40 aa, Artificial Sequence
  Description of Artificial Sequence: Synthetic polypeptide
ILIGNKADLDHQRQVTQEEGQQLARQLKVTYMEASAKIRM

SEQ ID NO: 4842 - protein, 40 aa, Artificial Sequence
  Description of Artificial Sequence: Synthetic polypeptide
KADLDHQRQVTQEEGQQLARQLKVTYMEASAKIRMNVDQA

SEQ ID NO: 4843 - protein, 40 aa, Artificial Sequence
  Description of Artificial Sequence: Synthetic polypeptide
DLDHQRQVTQEEGQQLARQLKVTYMEASAKIRMNVDQAFH

SEQ ID NO: 4844 - protein, 40 aa, Artificial Sequence
  Description of Artificial Sequence: Synthetic polypeptide
DHQRQVTQEEGQQLARQLKVTYMEASAKIRMNVDQAFHEL

SEQ ID NO: 4845 - protein, 40 aa, Artificial Sequence
  Description of Artificial Sequence: Synthetic polypeptide
RQVTQEEGQQLARQLKVTYMEASAKIRMNVDQAFHELVRV

SEQ ID NO: 4846 - protein, 40 aa, Artificial Sequence
  Description of Artificial Sequence: Synthetic polypeptide
TVMAGNDENYSAELRNATAAMKNQVARFNDLRFVGRSGRG

SEQ ID NO: 4847 - protein, 40 aa, Artificial Sequence
  Description of Artificial Sequence: Synthetic polypeptide
DENYSAELRNATAAMKNQVARFNDLRFVGRSGRGKSFTLT

SEQ ID NO: 4848 - protein, 40 aa, Artificial Sequence
  Description of Artificial Sequence: Synthetic polypeptide
HLYYGASAGSYQFSMVGGERSPPRILPPCTNASTGSALLN

SEQ ID NO: 4849 - protein, 40 aa, Artificial Sequence
  Description of Artificial Sequence: Synthetic polypeptide
MYYGASAGSYQFSMVGGERSPPRILPPCTNASTGSALLNP

SEQ ID NO: 4850 - protein, 40 aa, Artificial Sequence
  Description of Artificial Sequence: Synthetic polypeptide
GASAGSYQFSMVGGERSPPRILPPCTNASTGSALLNPSLP

SEQ ID NO: 4851 - protein, 40 aa, Artificial Sequence
  Description of Artificial Sequence: Synthetic polypeptide
KTHEDIEAQIREIQGKKAALDEAQGVGLDSTGYYDQEIYG

SEQ ID NO: 4852 - protein, 40 aa, Artificial Sequence
  Description of Artificial Sequence: Synthetic polypeptide
TKEEREIRQQLAEKAKAGELKVVNGAAASQPPSKRKRRWD

SEQ ID NO: 4853 - protein, 40 aa, Artificial Sequence
  Description of Artificial Sequence: Synthetic polypeptide
SGWAETPRTDRGGDSIGETPTPGASKRKSRWDETPASQMG

SEQ ID NO: 4854 - protein, 40 aa, Artificial Sequence
  Description of Artificial Sequence: Synthetic polypeptide
GWAETPRTDRGGDSIGETPTPGASKRKSRWDETPASQMGG

SEQ ID NO: 4855 - protein, 40 aa, Artificial Sequence
  Description of Artificial Sequence: Synthetic polypeptide
EQLQAWRWEREIDERNRPLSDEELDAMFPEGYKVLPPPAG

SEQ ID NO: 4856 - protein, 40 aa, Artificial Sequence
  Description of Artificial Sequence: Synthetic polypeptide
LQAWRWEREIDERNRPLSDEELDAMFPEGYKVLPPPAGYV

SEQ ID NO: 4857 - protein, 40 aa, Artificial Sequence
  Description of Artificial Sequence: Synthetic polypeptide
WEREIDERNRPLSDEELDAMFPEGYKVLPPPAGYVPIRTP

SEQ ID NO: 4858 - protein, 40 aa, Artificial Sequence
  Description of Artificial Sequence: Synthetic polypeptide
VLPPPAGYVPIRTPARKLTATPTPLGGMTGFHMQTEDRTM

SEQ ID NO: 4859 - protein, 40 aa, Artificial Sequence
  Description of Artificial Sequence: Synthetic polypeptide
SGNLPFLKPDDIQYFDKLLVDVDESTLSPEEQKERKIMKL

SEQ ID NO: 4860 - protein, 40 aa, Artificial Sequence
  Description of Artificial Sequence: Synthetic polypeptide
GNLPFLKPDDIQYFDKLLVDVDESTLSPEEQKERKIMKLL

SEQ ID NO: 4861 - protein, 40 aa, Artificial Sequence
  Description of Artificial Sequence: Synthetic polypeptide
PFLKPDDIQYFDKLLVDVDESTLSPEEQKERKIMKLLLKI

SEQ ID NO: 4862 - protein, 40 aa, Artificial Sequence
  Description of Artificial Sequence: Synthetic polypeptide
FLKPDDIQYFDKLLVDVDESTLSPEEQKERKIMKLLLKIK

SEQ ID NO: 4863 - protein, 40 aa, Artificial Sequence
  Description of Artificial Sequence: Synthetic polypeptide
KPDDIQYFDKLLVDVDESTLSPEEQKERKIMKLLLKIKNG

SEQ ID NO: 4864 - protein, 40 aa, Artificial Sequence
  Description of Artificial Sequence: Synthetic polypeptide
QYFDKLLVDVDESTLSPEEQKERKIMKLLLKIKNGTPPMR

SEQ ID NO: 4865 - protein, 40 aa, Artificial Sequence
  Description of Artificial Sequence: Synthetic polypeptide
EQKERKIMKLLLKIKNGTPPMRKAALRQITDKAREFGAGP

SEQ ID NO: 4866 - protein, 40 aa, Artificial Sequence
  Description of Artificial Sequence: Synthetic polypeptide
QKERKIMKLLLKIKNGTPPMRKAALRQITDKAREFGAGPL

SEQ ID NO: 4867 - protein, 40 aa, Artificial Sequence
  Description of Artificial Sequence: Synthetic polypeptide
KERKIMKLLLKIKNGTPPMRKAALRQITDKAREFGAGPLF

SEQ ID NO: 4868 - protein, 40 aa, Artificial Sequence
  Description of Artificial Sequence: Synthetic polypeptide
ERKIMKLLLKIKNGTPPMRKAALRQITDKAREFGAGPLFN

SEQ ID NO: 4869 - protein, 40 aa, Artificial Sequence
  Description of Artificial Sequence: Synthetic polypeptide
RKIMKLLLKIKNGTPPMRKAALRQITDKAREFGAGPLFNQ

SEQ ID NO: 4870 - protein, 40 aa, Artificial Sequence
  Description of Artificial Sequence: Synthetic polypeptide
KIMKLLLKIKNGTPPMRKAALRQITDKAREFGAGPLFNQI

SEQ ID NO: 4871 - protein, 40 aa, Artificial Sequence
  Description of Artificial Sequence: Synthetic polypeptide
IMKLLLKIKNGTPPMRKAALRQITDKAREFGAGPLFNQIL

SEQ ID NO: 4872 - protein, 40 aa, Artificial Sequence
  Description of Artificial Sequence: Synthetic polypeptide
DKAREFGAGPLFNQILPLLMSPTLEDQERHLLVKVIDRIL

SEQ ID NO: 4873 - protein, 40 aa, Artificial Sequence
  Description of Artificial Sequence: Synthetic polypeptide
AGPLFNQILPLLMSPTLEDQERHLLVKVIDRILYKLDDLV

SEQ ID NO: 4874 - protein, 40 aa, Artificial Sequence
  Description of Artificial Sequence: Synthetic polypeptide
RHLLVKVIDRILYKLDDLVRPYVHKILVVIEPLLIDEDYY

SEQ ID NO: 4875 - protein, 40 aa, Artificial Sequence
  Description of Artificial Sequence: Synthetic polypeptide
DDLVRPYVHKILVVIEPLLIDEDYYARVEGREIISNLAKA

SEQ ID NO: 4876 - protein, 40 aa, Artificial Sequence
  Description of Artificial Sequence: Synthetic polypeptide
KSKKSWQARHTGIKIVQQIAILMGCAILPHLRSLVEIIEH

SEQ ID NO: 4877 - protein, 40 aa, Artificial Sequence
  Description of Artificial Sequence: Synthetic polypeptide
HTGIKIVQQIAILMGCAILPHLRSLVEIIEHGLVDEQQKV

SEQ ID NO: 4878 - protein, 40 aa, Artificial Sequence
  Description of Artificial Sequence: Synthetic polypeptide
TISALAIAALAEAATPYGIESFDSVLKPLWKGIRQHRGKG

SEQ ID NO: 4879 - protein, 40 aa, Artificial Sequence
  Description of Artificial Sequence: Synthetic polypeptide
AEAATPYGIESFDSVLKPLWKGIRQHRGKGLAAFLKAIGY

SEQ ID NO: 4880 - protein, 40 aa, Artificial Sequence
  Description of Artificial Sequence: Synthetic polypeptide
AATPYGIESFDSVLKPLWKGIRQHRGKGLAAFLKAIGYLI

SEQ ID NO: 4881 - protein, 40 aa, Artificial Sequence
  Description of Artificial Sequence: Synthetic polypeptide
GIESFDSVLKPLWKGIRQHRGKGLAAFLKAIGYLIPLMDA

SEQ ID NO: 4882 - protein, 40 aa, Artificial Sequence
  Description of Artificial Sequence: Synthetic polypeptide
ESFDSVLKPLWKGIRQHRGKGLAAFLKAIGYLIPLMDAEY

SEQ ID NO: 4883 - protein, 40 aa, Artificial Sequence
  Description of Artificial Sequence: Synthetic polypeptide
SFDSVLKPLWKGIRQHRGKGLAAFLKAIGYLIPLMDAEYA

SEQ ID NO: 4884 - protein, 40 aa, Artificial Sequence
  Description of Artificial Sequence: Synthetic polypeptide
FDSVLKPLWKGIRQHRGKGLAAFLKAIGYLIPLMDAEYAN

SEQ ID NO: 4885 - protein, 40 aa, Artificial Sequence
  Description of Artificial Sequence: Synthetic polypeptide
KGIRQHRGKGLAAFLKAIGYLIPLMDAEYANYYTREVMLI

SEQ ID NO: 4886 - protein, 40 aa, Artificial Sequence
  Description of Artificial Sequence: Synthetic polypeptide
ILIREFQSPDEEMKKIVLKVVKQCCGTDGVEANYIKTEIL

SEQ ID NO: 4887 - protein, 40 aa, Artificial Sequence
  Description of Artificial Sequence: Synthetic polypeptide
IREFQSPDEEMKKIVLKVVKQCCGTDGVEANYIKTEILPP

SEQ ID NO: 4888 - protein, 40 aa, Artificial Sequence
  Description of Artificial Sequence: Synthetic polypeptide
REFQSPDEEMKKIVLKVVKQCCGTDGVEANYIKTEILPPF

SEQ ID NO: 4889 - protein, 40 aa, Artificial Sequence
  Description of Artificial Sequence: Synthetic polypeptide
IKTEILPPFFKHFWQHRMALDRRNYRQLVDTTVELANKVG

SEQ ID NO: 4890 - protein, 40 aa, Artificial Sequence
  Description of Artificial Sequence: Synthetic polypeptide
KTEILPPFFKHFWQHRMALDRRNYRQLVDTTVELANKVGA

SEQ ID NO: 4891 - protein, 40 aa, Artificial Sequence
  Description of Artificial Sequence: Synthetic polypeptide
ELANKVGAAEIISRIVDDLKDEAEQYRKMVMETIEKIMGN

SEQ ID NO: 4892 - protein, 40 aa, Artificial Sequence
  Description of Artificial Sequence: Synthetic polypeptide
MANKVGAAEIISRIVDDLKDEAEQYRKMVMETIEKIMGNL

SEQ ID NO: 4893 - protein, 40 aa, Artificial Sequence
  Description of Artificial Sequence: Synthetic polypeptide
AAEIISRIVDDLKDEAEQYRKMVMETIEKIMGNLGAADID

SEQ ID NO: 4894 - protein, 40 aa, Artificial Sequence
  Description of Artificial Sequence: Synthetic polypeptide
KDEAEQYRKMVMETIEKIMGNLGAADIDHKLEEQLIDGIL

SEQ ID NO: 4895 - protein, 40 aa, Artificial Sequence
  Description of Artificial Sequence: Synthetic polypeptide
SAKVRQQAADLISRTAVVMKTCQEEKLMGHLGVVLYEYLG

SEQ ID NO: 4896 - protein, 40 aa, Artificial Sequence
  Description of Artificial Sequence: Synthetic polypeptide
EKLMGHLGVVLYEYLGEEYPEVLGSILGALKAIVNVIGMH

SEQ ID NO: 4897 - protein, 40 aa, Artificial Sequence
  Description of Artificial Sequence: Synthetic polypeptide
HEKVQENCIDLVGRIADRGAEYVSAREWMRICFELLELLK

SEQ ID NO: 4898 - protein, 40 aa, Artificial Sequence
  Description of Artificial Sequence: Synthetic polypeptide
SAREWMRICFELLELLKAHKKAIRRATVNTFGYIAKAIGP

SEQ ID NO: 4899 - protein, 40 aa, Artificial Sequence
  Description of Artificial Sequence: Synthetic polypeptide
AHKKAIRRATVNTFGYIAKAIGPHDVLATLLNNLKVQERQ

SEQ ID NO: 4900 - protein, 40 aa, Artificial Sequence
  Description of Artificial Sequence: Synthetic polypeptide
KAIRRATVNTFGYIAKAIGPHDVLATLLNNLKVQERQNRV

SEQ ID NO: 4901 - protein, 40 aa, Artificial Sequence
  Description of Artificial Sequence: Synthetic polypeptide
AKAIGPHDVLATLLNNLKVQERQNRVCTTVAIAIVAETCS

SEQ ID NO: 4902 - protein, 40 aa, Artificial Sequence
  Description of Artificial Sequence: Synthetic polypeptide
CTTVAIAIVAETCSPFTVLPALMNEYRVPELNVQNGVLKS

SEQ ID NO: 4903 - protein, 40 aa, Artificial Sequence
  Description of Artificial Sequence: Synthetic polypeptide
PFTVLPALMNEYRVPELNVQNGVLKSLSFLFEYIGEMGKD

SEQ ID NO: 4904 - protein, 40 aa, Artificial Sequence
  Description of Artificial Sequence: Synthetic polypeptide
TVLPALMNEYRVPELNVQNGVLKSLSFLFEYIGEMGKDYI

SEQ ID NO: 4905 - protein, 40 aa, Artificial Sequence
  Description of Artificial Sequence: Synthetic polypeptide
LPALMNEYRVPELNVQNGVLKSLSFLFEYIGEMGKDYIYA

SEQ ID NO: 4906 - protein, 40 aa, Artificial Sequence
  Description of Artificial Sequence: Synthetic polypeptide
PALMNEYRVPELNVQNGVLKSLSFLFEYIGEMGKDYIYAV

SEQ ID NO: 4907 - protein, 40 aa, Artificial Sequence
  Description of Artificial Sequence: Synthetic polypeptide
ALMNEYRVPELNVQNGVLKSLSFLFEYIGEMGKDYIYAVT

SEQ ID NO: 4908 - protein, 40 aa, Artificial Sequence
  Description of Artificial Sequence: Synthetic polypeptide
LMNEYRVPELNVQNGVLKSLSFLFEYIGEMGKDYIYAVTP

SEQ ID NO: 4909 - protein, 40 aa, Artificial Sequence
  Description of Artificial Sequence: Synthetic polypeptide
MNEYRVPELNVQNGVLKSLSFLFEYIGEMGKDYIYAVTPL

SEQ ID NO: 4910 - protein, 40 aa, Artificial Sequence
  Description of Artificial Sequence: Synthetic polypeptide
MNVQNGVLKSLSFLFEYIGEMGKDYIYAVTPLLEDALMDR

SEQ ID NO: 4911 - protein, 40 aa, Artificial Sequence
  Description of Artificial Sequence: Synthetic polypeptide
NGVLKSLSFLFEYIGEMGKDYIYAVTPLLEDALMDRDLVH

SEQ ID NO: 4912 - protein, 40 aa, Artificial Sequence
  Description of Artificial Sequence: Synthetic polypeptide
LMDRDLVHRQTASAVVQHMSLGVYGFGCEDSLNHLLNYVW

SEQ ID NO: 4913 - protein, 40 aa, Artificial Sequence
  Description of Artificial Sequence: Synthetic polypeptide
DSLNHLLNYVWPNVFETSPHVIQAVMGALEGLRVAIGPCR

SEQ ID NO: 4914 - protein, 40 aa, Artificial Sequence
  Description of Artificial Sequence: Synthetic polypeptide
MNYVWPNVFETSPHVIQAVMGALEGLRVAIGPCRMLQYCL

SEQ ID NO: 4915 - protein, 40 aa, Artificial Sequence
  Description of Artificial Sequence: Synthetic polypeptide
VFETSPHVIQAVMGALEGLRVAIGPCRMLQYCLQGLFHPA

SEQ ID NO: 4916 - protein, 40 aa, Artificial Sequence
  Description of Artificial Sequence: Synthetic polypeptide
SPHVIQAVMGALEGLRVAIGPCRMLQYCLQGLFHPARKVR

SEQ ID NO: 4917 - protein, 40 aa, Artificial Sequence
  Description of Artificial Sequence: Synthetic polypeptide
QAVMGALEGLRVAIGPCRMLQYCLQGLFHPARKVRDVYWK

SEQ ID NO: 4918 - protein, 40 aa, Artificial Sequence
  Description of Artificial Sequence: Synthetic polypeptide
AVMGALEGLRVAIGPCRMLQYCLQGLFHPARKVRDVYWKI

SEQ ID NO: 4919 - protein, 40 aa, Artificial Sequence
  Description of Artificial Sequence: Synthetic polypeptide
VMGALEGLRVAIGPCRMLQYCLQGLFHPARKVRDVYWKIY

SEQ ID NO: 4920 - protein, 40 aa, Artificial Sequence
  Description of Artificial Sequence: Synthetic polypeptide
ALEGLRVAIGPCRMLQYCLQGLFHPARKVRDVYWKIYNSI

SEQ ID NO: 4921 - protein, 40 aa, Artificial Sequence
  Description of Artificial Sequence: Synthetic polypeptide
VAIGPCRMLQYCLQGLFHPARKVRDVYWKIYNSIYIGSQD

SEQ ID NO: 4922 - protein, 40 aa, Artificial Sequence
  Description of Artificial Sequence: Synthetic polypeptide
PCRMLQYCLQGLFHPARKVRDVYWKIYNSIYIGSQDALIA

SEQ ID NO: 4923 - protein, 40 aa, Artificial Sequence
  Description of Artificial Sequence: Synthetic polypeptide
LNRENFPGVSWDSLPDELLLGIFSCLCLPELLKVSGVCKR

SEQ ID NO: 4924 - protein, 40 aa, Artificial Sequence
  Description of Artificial Sequence: Synthetic polypeptide
NRENFPGVSWDSLPDELLLGIFSCLCLPELLKVSGVCKRW

SEQ ID NO: 4925 - protein, 40 aa, Artificial Sequence
  Description of Artificial Sequence: Synthetic polypeptide
ENFPGVSWDSLPDELLLGIFSCLCLPELLKVSGVCKRWYR

SEQ ID NO: 4926 - protein, 40 aa, Artificial Sequence
  Description of Artificial Sequence: Synthetic polypeptide
NFPGVSWDSLPDELLLGIFSCLCLPELLKVSGVCKRWYRL

SEQ ID NO: 4927 - protein, 40 aa, Artificial Sequence
  Description of Artificial Sequence: Synthetic polypeptide
WDSLPDELLLGIFSCLCLPELLKVSGVCKRWYRLASDESL

SEQ ID NO: 4928 - protein, 40 aa, Artificial Sequence
  Description of Artificial Sequence: Synthetic polypeptide
DSLPDELLLGIFSCLCLPELLKVSGVCKRWYRLASDESLW

SEQ ID NO: 4929 - protein, 40 aa, Artificial Sequence
  Description of Artificial Sequence: Synthetic polypeptide
SGVCKRWYRLASDESLWQTLDLTGKNLHPDVTGRLLSQGV

SEQ ID NO: 4930 - protein, 40 aa, Artificial Sequence
  Description of Artificial Sequence: Synthetic polypeptide
TGKNLHPDVTGRLLSQGVIAFRCPRSFMDQPLAEHFSPFR

SEQ ID NO: 4931 - protein, 40 aa, Artificial Sequence
  Description of Artificial Sequence: Synthetic polypeptide
GLRLSDPIVNTLAKNSNLVRLNLSGCSGFSEFALQTLLSS

SEQ ID NO: 4932 - protein, 40 aa, Artificial Sequence
  Description of Artificial Sequence: Synthetic polypeptide
MPFTPPVVKRLLGWKKSAGGSGGAGGGEQNGQEEKWCEKA

SEQ ID NO: 4933 - protein, 40 aa, Artificial Sequence
  Description of Artificial Sequence: Synthetic polypeptide
PFTPPVVKRLLGWKKSAGGSGGAGGGEQNGQEEKWCEKAV

SEQ ID NO: 4934 - protein, 40 aa, Artificial Sequence
  Description of Artificial Sequence: Synthetic polypeptide
SEIWGLSTPNTIDQWDTTGLYSFSEQTRSLDGRLQVSHRK

SEQ ID NO: 4935 - protein, 40 aa, Artificial Sequence
  Description of Artificial Sequence: Synthetic polypeptide
MDDYTHSIPENTNFPAGIEPQSNYIPETPPPGYISEDGET

SEQ ID NO: 4936 - protein, 40 aa, Artificial Sequence
  Description of Artificial Sequence: Synthetic polypeptide
CLGLLSNVNRNATVEMTRRHIGRGVRLYYIGGEVFAECLS

SEQ ID NO: 4937 - protein, 40 aa, Artificial Sequence
  Description of Artificial Sequence: Synthetic polypeptide
RRHIGRGVRLYYIGGEVFAECLSDSAIFVQSPNCNQRYGW

SEQ ID NO: 4938 - protein, 40 aa, Artificial Sequence
  Description of Artificial Sequence: Synthetic polypeptide
TFAKRAIESLVKKLKEKKDELDSLITAITTNGAHPSKCVT

SEQ ID NO: 4939 - protein, 40 aa, Artificial Sequence
  Description of Artificial Sequence: Synthetic polypeptide
VIYARLWRWPDLHKNELKHVKYCQYAFDLKCDSVCVNPYH

SEQ ID NO: 4940 - protein, 40 aa, Artificial Sequence
  Description of Artificial Sequence: Synthetic polypeptide
LWRWPDLHKNELKHVKYCQYAFDLKCDSVCVNPYHYERVV

SEQ ID NO: 4941 - protein, 40 aa, Artificial Sequence
  Description of Artificial Sequence: Synthetic polypeptide
HKNELKHVKYCQYAFDLKCDSVCVNPYHYERVVSPGIDLS

SEQ ID NO: 4942 - protein, 40 aa, Artificial Sequence
  Description of Artificial Sequence: Synthetic polypeptide
KNELKHVKYCQYAFDLKCDSVCVNPYHYERVVSPGIDLSG

SEQ ID NO: 4943 - protein, 40 aa, Artificial Sequence
  Description of Artificial Sequence: Synthetic polypeptide
HPGHYWPVHNELAFQPPISNHPAPEYWCSIAYFEMDVQVG

SEQ ID NO: 4944 - protein, 40 aa, Artificial Sequence
  Description of Artificial Sequence: Synthetic polypeptide
HYWPVHNELAFQPPISNHPAPEYWCSIAYFEMDVQVGETF

SEQ ID NO: 4945 - protein, 40 aa, Artificial Sequence
  Description of Artificial Sequence: Synthetic polypeptide
ELAFQPPISNHPAPEYWCSIAYFEMDVQVGETFKVPSSCP

SEQ ID NO: 4946 - protein, 40 aa, Artificial Sequence
  Description of Artificial Sequence: Synthetic polypeptide
QPPISNHPAPEYWCSIAYFEMDVQVGETFKVPSSCPIVTV

SEQ ID NO: 4947 - protein, 40 aa, Artificial Sequence
  Description of Artificial Sequence: Synthetic polypeptide
PPISNHPAPEYWCSIAYFEMDVQVGETFKVPSSCPIVTVD

SEQ ID NO: 4948 - protein, 40 aa, Artificial Sequence
  Description of Artificial Sequence: Synthetic polypeptide
PAPEYWCSIAYFEMDVQVGETFKVPSSCPIVTVDGYVDPS

SEQ ID NO: 4949 - protein, 40 aa, Artificial Sequence
  Description of Artificial Sequence: Synthetic polypeptide
APEYWCSIAYFEMDVQVGETFKVPSSCPIVTVDGYVDPSG

SEQ ID NO: 4950 - protein, 40 aa, Artificial Sequence
  Description of Artificial Sequence: Synthetic polypeptide
SIAYFEMDVQVGETFKVPSSCPIVTVDGYVDPSGGDRFCL

SEQ ID NO: 4951 - protein, 40 aa, Artificial Sequence
  Description of Artificial Sequence: Synthetic polypeptide
IAYFEMDVQVGETFKVPSSCPIVTVDGYVDPSGGDRFCLG

SEQ ID NO: 4952 - protein, 40 aa, Artificial Sequence
  Description of Artificial Sequence: Synthetic polypeptide
AYFEMDVQVGETFKVPSSCPIVTVDGYVDPSGGDRFCLGQ

SEQ ID NO: 4953 - protein, 40 aa, Artificial Sequence
  Description of Artificial Sequence: Synthetic polypeptide
MDVQVGETFKVPSSCPIVTVDGYVDPSGGDRFCLGQLSNV

SEQ ID NO: 4954 - protein, 40 aa, Artificial Sequence
  Description of Artificial Sequence: Synthetic polypeptide
VQVGETFKVPSSCPIVTVDGYVDPSGGDRFCLGQLSNVHR

SEQ ID NO: 4955 - protein, 40 aa, Artificial Sequence
  Description of Artificial Sequence: Synthetic polypeptide
AIERARLHIGKGVQLECKGEGDVWVRCLSDHAVFVQSYYL

SEQ ID NO: 4956 - protein, 40 aa, Artificial Sequence
  Description of Artificial Sequence: Synthetic polypeptide
ARLHIGKGVQLECKGEGDVWVRCLSDHAVFVQSYYLDREA

SEQ ID NO: 4957 - protein, 40 aa, Artificial Sequence
  Description of Artificial Sequence: Synthetic polypeptide
KGVQLECKGEGDVWVRCLSDHAVFVQSYYLDREAGRAPGD

SEQ ID NO: 4958 - protein, 40 aa, Artificial Sequence
  Description of Artificial Sequence: Synthetic polypeptide
GEGDVWVRCLSDHAVFVQSYYLDREAGRAPGDAVHKIYPS

SEQ ID NO: 4959 - protein, 40 aa, Artificial Sequence
  Description of Artificial Sequence: Synthetic polypeptide
PSAYIKVFDLRQCHRQMQQQAATAQAAAAAQAAAVAGNIP

SEQ ID NO: 4960 - protein, 40 aa, Artificial Sequence
  Description of Artificial Sequence: Synthetic polypeptide
RAVRSLLRSHYREVLPLATFVRRLGPQGWRLVQRGDPAAF

SEQ ID NO: 4961 - protein, 40 aa, Artificial Sequence
  Description of Artificial Sequence: Synthetic polypeptide
REVLPLATFVRRLGPQGWRLVQRGDPAAFRALVAQCLVCV

SEQ ID NO: 4962 - protein, 40 aa, Artificial Sequence
  Description of Artificial Sequence: Synthetic polypeptide
DALRGSGAWGLLLRRVGDDVLVHLLARCALFVLVAPSCAY

SEQ ID NO: 4963 - protein, 40 aa, Artificial Sequence
  Description of Artificial Sequence: Synthetic polypeptide
SGAWGLLLRRVGDDVLVHLLARCALFVLVAPSCAYQVCGP

SEQ ID NO: 4964 - protein, 40 aa, Artificial Sequence
  Description of Artificial Sequence: Synthetic polypeptide
EILAKFLHWLMSVYVVELLRSFFYVTETTFQKNRLFFYRK

SEQ ID NO: 4965 - protein, 40 aa, Artificial Sequence
  Description of Artificial Sequence: Synthetic polypeptide
MAKFLHWLMSVYVVELLRSFFYVTETTFQKNRLFFYRKSV

SEQ ID NO: 4966 - protein, 40 aa, Artificial Sequence
  Description of Artificial Sequence: Synthetic polypeptide
FLHWLMSVYVVELLRSFFYVTETTFQKNRLFFYRKSVWSK

SEQ ID NO: 4967 - protein, 40 aa, Artificial Sequence
  Description of Artificial Sequence: Synthetic polypeptide
MHWLMSVYVVELLRSFFYVTETTFQKNRLFFYRKSVWSKL

SEQ ID NO: 4968 - protein, 40 aa, Artificial Sequence
  Description of Artificial Sequence: Synthetic polypeptide
HWLMSVYVVELLRSFFYVTETTFQKNRLFFYRKSVWSKLQ

SEQ ID NO: 4969 - protein, 40 aa, Artificial Sequence
  Description of Artificial Sequence: Synthetic polypeptide
VVELLRSFFYVTETTFQKNRLFFYRKSVWSKLQSIGIRQH

SEQ ID NO: 4970 - protein, 40 aa, Artificial Sequence
  Description of Artificial Sequence: Synthetic polypeptide
QKNRLFFYRKSVWSKLQSIGIRQHLKRVQLRELSEAEVRQ

SEQ ID NO: 4971 - protein, 40 aa, Artificial Sequence
  Description of Artificial Sequence: Synthetic polypeptide
RREKRAERLTSRVKALFSVLNYERARRPGLLGASVLGLDD

SEQ ID NO: 4972 - protein, 40 aa, Artificial Sequence
  Description of Artificial Sequence: Synthetic polypeptide
LNYERARRPGLLGASVLGLDDIHRAWRTFVLRVRAQDPPP

SEQ ID NO: 4973 - protein, 40 aa, Artificial Sequence
  Description of Artificial Sequence: Synthetic polypeptide
RARRPGLLGASVLGLDDIHRAWRTFVLRVRAQDPPPELYF

SEQ ID NO: 4974 - protein, 40 aa, Artificial Sequence
  Description of Artificial Sequence: Synthetic polypeptide
YGDMENKLFAGIRRDGLLLRLVDDFLLVTPHLTHAKTFLR

SEQ ID NO: 4975 - protein, 40 aa, Artificial Sequence
  Description of Artificial Sequence: Synthetic polypeptide
HSLFLDLQVNSLQTVCTNIYKILLLQAYRFHACVLQLPFH

SEQ ID NO: 4976 - protein, 40 aa, Artificial Sequence
  Description of Artificial Sequence: Synthetic polypeptide
VPLLGSLRTAQTQLSRKLPGTTLTALEAAANPALPSDFKT

SEQ ID NO: 4977 - protein, 40 aa, Artificial Sequence
  Description of Artificial Sequence: Synthetic polypeptide
TVCHDPKLPYHDFILEDAASPKCIMKEKKKPGETFFMCSC

SEQ ID NO: 4978 - protein, 40 aa, Artificial Sequence
  Description of Artificial Sequence: Synthetic polypeptide
HDPKLPYHDFILEDAASPKCIMKEKKKPGETFFMCSCSSD

SEQ ID NO: 4979 - protein, 40 aa, Artificial Sequence
  Description of Artificial Sequence: Synthetic polypeptide
LPYHDFILEDAASPKCIMKEKKKPGETFFMCSCSSDECND

SEQ ID NO: 4980 - protein, 40 aa, Artificial Sequence
  Description of Artificial Sequence: Synthetic polypeptide
PYHDFILEDAASPKCIMKEKKKPGETFFMCSCSSDECNDN

SEQ ID NO: 4981 - protein, 40 aa, Artificial Sequence
  Description of Artificial Sequence: Synthetic polypeptide
YHDFILEDAASPKCIMKEKKKPGETFFMCSCSSDECNDNI

SEQ ID NO: 4982 - protein, 40 aa, Artificial Sequence
  Description of Artificial Sequence: Synthetic polypeptide
HDFILEDAASPKCIMKEKKKPGETFFMCSCSSDECNDNII

SEQ ID NO: 4983 - protein, 40 aa, Artificial Sequence
  Description of Artificial Sequence: Synthetic polypeptide
DFILEDAASPKCIMKEKKKPGETFFMCSCSSDECNDNIIF

SEQ ID NO: 4984 - protein, 40 aa, Artificial Sequence
  Description of Artificial Sequence: Synthetic polypeptide
FILEDAASPKCIMKEKKKPGETFFMCSCSSDECNDNIIFS

SEQ ID NO: 4985 - protein, 40 aa, Artificial Sequence
  Description of Artificial Sequence: Synthetic polypeptide
ILEDAASPKCIMKEKKKPGETFFMCSCSSDECNDNIIFSE

SEQ ID NO: 4986 - protein, 40 aa, Artificial Sequence
  Description of Artificial Sequence: Synthetic polypeptide
MEDAASPKCIMKEKKKPGETFFMCSCSSDECNDNIIFSEE

SEQ ID NO: 4987 - protein, 40 aa, Artificial Sequence
  Description of Artificial Sequence: Synthetic polypeptide
EDAASPKCIMKEKKKPGETFFMCSCSSDECNDNIIFSEEY

SEQ ID NO: 4988 - protein, 40 aa, Artificial Sequence
  Description of Artificial Sequence: Synthetic polypeptide
CLCDFGLSLRLDPTLSVDDLANSGQVGTARYMAPEVLESR

SEQ ID NO: 4989 - protein, 40 aa, Artificial Sequence
  Description of Artificial Sequence: Synthetic polypeptide
SSCMGGMNRRPILTIITLEDSSGNLLGRNSFEVRVCACPG

SEQ ID NO: 4990 - protein, 40 aa, Artificial Sequence
  Description of Artificial Sequence: Synthetic polypeptide
CMGGMNRRPILTIITLEDSSGNLLGRNSFEVRVCACPGRD

SEQ ID NO: 4991 - protein, 40 aa, Artificial Sequence
  Description of Artificial Sequence: Synthetic polypeptide
VPSLNVDGQPIFANITLPVYTLKERCLQVVRSLVKPENYR

SEQ ID NO: 4992 - protein, 40 aa, Artificial Sequence
  Description of Artificial Sequence: Synthetic polypeptide
NVDGQPIFANITLPVYTLKERCLQVVRSLVKPENYRRLDI

SEQ ID NO: 4993 - protein, 40 aa, Artificial Sequence
  Description of Artificial Sequence: Synthetic polypeptide
MKERCLQVVRSLVKPENYRRLDIVRSLYEDLEDHPNVQKD

SEQ ID NO: 4994 - protein, 40 aa, Artificial Sequence
  Description of Artificial Sequence: Synthetic polypeptide
ERCLQVVRSLVKPENYRRLDIVRSLYEDLEDHPNVQKDLE

SEQ ID NO: 4995 - protein, 40 aa, Artificial Sequence
  Description of Artificial Sequence: Synthetic polypeptide
CLQVVRSLVKPENYRRLDIVRSLYEDLEDHPNVQKDLERL

SEQ ID NO: 4996 - protein, 40 aa, Artificial Sequence
  Description of Artificial Sequence: Synthetic polypeptide
KPENYRRLDIVRSLYEDLEDHPNVQKDLERLTQERIAHQR

SEQ ID NO: 4997 - protein, 40 aa, Artificial Sequence
  Description of Artificial Sequence: Synthetic polypeptide
PENYRRLDIVRSLYEDLEDHPNVQKDLERLTQERIAHQRM

SEQ ID NO: 4998 - protein, 40 aa, Artificial Sequence
  Description of Artificial Sequence: Synthetic polypeptide
PQPAPQGQGQPPSQPPQGQGPPSGPGQPAPAATQAAPQAP

SEQ ID NO: 4999 - protein, 40 aa, Artificial Sequence
  Description of Artificial Sequence: Synthetic polypeptide
NRFPDYLEAIPGTNVDLGTLEGDGMNIEGEELMPSLQEAL

SEQ ID NO: 5000 - protein, 40 aa, Artificial Sequence
  Description of Artificial Sequence: Synthetic polypeptide
RPQDVDQREAPLNNFSVAQCQLMKTERPRPNTFIIRCLQW

SEQ ID NO: 5001 - protein, 40 aa, Artificial Sequence
  Description of Artificial Sequence: Synthetic polypeptide
QWTTVIERTFHVETPEEREEWTTAIQTVADGLKKQEEEEM

SEQ ID NO: 5002 - protein, 40 aa, Artificial Sequence
  Description of Artificial Sequence: Synthetic polypeptide
GGELFFHLSRERVFSEDRARFYGAEIVSALDYLHSEKNVV

SEQ ID NO: 5003 - protein, 40 aa, Artificial Sequence
  Description of Artificial Sequence: Synthetic polypeptide
EMMCGRLPFYNQDHEKLFELILMEEIRFPRTLGPEAKSLL

SEQ ID NO: 5004 - protein, 40 aa, Artificial Sequence
  Description of Artificial Sequence: Synthetic polypeptide
CGRLPFYNQDHEKLFELILMEEIRFPRTLGPEAKSLLSGL

SEQ ID NO: 5005 - protein, 40 aa, Artificial Sequence
  Description of Artificial Sequence: Synthetic polypeptide
PEAKSLLSGLLKKDPKQRLGGGSEDAKEIMQHRFFAGIVW

SEQ ID NO: 5006 - protein, 40 aa, Artificial Sequence
  Description of Artificial Sequence: Synthetic polypeptide
MQHRFFAGIVWQHVYEKKLSPPFKPQVTSETDTRYFDEEF

SEQ ID NO: 5007 - protein, 40 aa, Artificial Sequence
  Description of Artificial Sequence: Synthetic polypeptide
RFFAGIVWQHVYEKKLSPPFKPQVTSETDTRYFDEEFTAQ

SEQ ID NO: 5008 - protein, 40 aa, Artificial Sequence
  Description of Artificial Sequence: Synthetic polypeptide
FAGIVWQHVYEKKLSPPFKPQVTSETDTRYFDEEFTAQMI

SEQ ID NO: 5009 - protein, 40 aa, Artificial Sequence
  Description of Artificial Sequence: Synthetic polypeptide
WQHVYEKKLSPPFKPQVTSETDTRYFDEEFTAQMITITPP

SEQ ID NO: 5010 - protein, 40 aa, Artificial Sequence
  Description of Artificial Sequence: Synthetic polypeptide
PQVTSETDTRYFDEEFTAQMITITPPDQDDSMECVDSERR

SEQ ID NO: 5011 - protein, 40 aa, Artificial Sequence
  Description of Artificial Sequence: Synthetic polypeptide
QQQQQQQQQQQQQQQQQQQQQETSPRQQQQQQGEDGSPQA

SEQ ID NO: 5012 - protein, 40 aa, Artificial Sequence
  Description of Artificial Sequence: Synthetic polypeptide
LGGTSTISDNAKELCKAVSVSMGLGVEALEHLSPGEQLRG

SEQ ID NO: 5013 - protein, 40 aa, Artificial Sequence
  Description of Artificial Sequence: Synthetic polypeptide
GGTSTISDNAKELCKAVSVSMGLGVEALEHLSPGEQLRGD

SEQ ID NO: 5014 - protein, 40 aa, Artificial Sequence
  Description of Artificial Sequence: Synthetic polypeptide
ISDNAKELCKAVSVSMGLGVEALEHLSPGEQLRGDCMYAP

SEQ ID NO: 5015 - protein, 40 aa, Artificial Sequence
  Description of Artificial Sequence: Synthetic polypeptide
PCAPLAECKGSLLDDSAGKSTEDTAEYSPFKGGYTKGLEG

SEQ ID NO: 5016 - protein, 40 aa, Artificial Sequence
  Description of Artificial Sequence: Synthetic polypeptide
ARIKLENPLDYGSAWAAAAAQCRYGDLASLHGAGAAGPGS

SEQ ID NO: 5017 - protein, 40 aa, Artificial Sequence
  Description of Artificial Sequence: Synthetic polypeptide
AWAAAAAQCRYGDLASLHGAGAAGPGSGSPSAAASSSWHT

SEQ ID NO: 5018 - protein, 40 aa, Artificial Sequence
  Description of Artificial Sequence: Synthetic polypeptide
APYGYTRPPQGLAGQESDFTAPDVWYPGGMVSRVPYPSPT

SEQ ID NO: 5019 - protein, 40 aa, Artificial Sequence
  Description of Artificial Sequence: Synthetic polypeptide
DYYFPPQKTCLICGDEASGCHYGALTCGSCKVFFKRAAEG

SEQ ID NO: 5020 - protein, 40 aa, Artificial Sequence
  Description of Artificial Sequence: Synthetic polypeptide
YYFPPQKTCLICGDEASGCHYGALTCGSCKVFFKRAAEGK

SEQ ID NO: 5021 - protein, 40 aa, Artificial Sequence
  Description of Artificial Sequence: Synthetic polypeptide
QKTCLICGDEASGCHYGALTCGSCKVFFKRAAEGKQKYLC

SEQ ID NO: 5022 - protein, 40 aa, Artificial Sequence
  Description of Artificial Sequence: Synthetic polypeptide
DEASGCHYGALTCGSCKVFFKRAAEGKQKYLCASRNDCTI

SEQ ID NO: 5023 - protein, 40 aa, Artificial Sequence
  Description of Artificial Sequence: Synthetic polypeptide
EASGCHYGALTCGSCKVFFKRAAEGKQKYLCASRNDCTID

SEQ ID NO: 5024 - protein, 40 aa, Artificial Sequence
  Description of Artificial Sequence: Synthetic polypeptide
CHYGALTCGSCKVFFKRAAEGKQKYLCASRNDCTIDKFRR

SEQ ID NO: 5025 - protein, 40 aa, Artificial Sequence
  Description of Artificial Sequence: Synthetic polypeptide
HYGALTCGSCKVFFKRAAEGKQKYLCASRNDCTIDKFRRK

SEQ ID NO: 5026 - protein, 40 aa, Artificial Sequence
  Description of Artificial Sequence: Synthetic polypeptide
YGALTCGSCKVFFKRAAEGKQKYLCASRNDCTIDKFRRKN

SEQ ID NO: 5027 - protein, 40 aa, Artificial Sequence
  Description of Artificial Sequence: Synthetic polypeptide
GALTCGSCKVFFKRAAEGKQKYLCASRNDCTIDKFRRKNC

SEQ ID NO: 5028 - protein, 40 aa, Artificial Sequence
  Description of Artificial Sequence: Synthetic polypeptide
SRNDCTIDKFRRKNCPSCRLRKCYEAGMTLGARKLKKLGN

SEQ ID NO: 5029 - protein, 40 aa, Artificial Sequence
  Description of Artificial Sequence: Synthetic polypeptide
RNDCTIDKFRRKNCPSCRLRKCYEAGMTLGARKLKKLGNL

SEQ ID NO: 5030 - protein, 40 aa, Artificial Sequence
  Description of Artificial Sequence: Synthetic polypeptide
NDCTIDKFRRKNCPSCRLRKCYEAGMTLGARKLKKLGNLK

SEQ ID NO: 5031 - protein, 40 aa, Artificial Sequence
  Description of Artificial Sequence: Synthetic polypeptide
DCTIDKFRRKNCPSCRLRKCYEAGMTLGARKLKKLGNLKL

SEQ ID NO: 5032 - protein, 40 aa, Artificial Sequence
  Description of Artificial Sequence: Synthetic polypeptide
TIDKFRRKNCPSCRLRKCYEAGMTLGARKLKKLGNLKLQE

SEQ ID NO: 5033 - protein, 40 aa, Artificial Sequence
  Description of Artificial Sequence: Synthetic polypeptide
IDKFRRKNCPSCRLRKCYEAGMTLGARKLKKLGNLKLQEE

SEQ ID NO: 5034 - protein, 40 aa, Artificial Sequence
  Description of Artificial Sequence: Synthetic polypeptide
DKFRRKNCPSCRLRKCYEAGMTLGARKLKKLGNLKLQEEG

SEQ ID NO: 5035 - protein, 40 aa, Artificial Sequence
  Description of Artificial Sequence: Synthetic polypeptide
KFRRKNCPSCRLRKCYEAGMTLGARKLKKLGNLKLQEEGE

SEQ ID NO: 5036 - protein, 40 aa, Artificial Sequence
  Description of Artificial Sequence: Synthetic polypeptide
FRRKNCPSCRLRKCYEAGMTLGARKLKKLGNLKLQEEGEA

SEQ ID NO: 5037 - protein, 40 aa, Artificial Sequence
  Description of Artificial Sequence: Synthetic polypeptide
RRKNCPSCRLRKCYEAGMTLGARKLKKLGNLKLQEEGEAS

SEQ ID NO: 5038 - protein, 40 aa, Artificial Sequence
  Description of Artificial Sequence: Synthetic polypeptide
RKNCPSCRLRKCYEAGMTLGARKLKKLGNLKLQEEGEASS

SEQ ID NO: 5039 - protein, 40 aa, Artificial Sequence
  Description of Artificial Sequence: Synthetic polypeptide
KNCPSCRLRKCYEAGMTLGARKLKKLGNLKLQEEGEASST

SEQ ID NO: 5040 - protein, 40 aa, Artificial Sequence
  Description of Artificial Sequence: Synthetic polypeptide
NCPSCRLRKCYEAGMTLGARKLKKLGNLKLQEEGEASSTT

SEQ ID NO: 5041 - protein, 40 aa, Artificial Sequence
  Description of Artificial Sequence: Synthetic polypeptide
CPSCRLRKCYEAGMTLGARKLKKLGNLKLQEEGEASSTTS

SEQ ID NO: 5042 - protein, 40 aa, Artificial Sequence
  Description of Artificial Sequence: Synthetic polypeptide
SCRLRKCYEAGMTLGARKLKKLGNLKLQEEGEASSTTSPT

SEQ ID NO: 5043 - protein, 40 aa, Artificial Sequence
  Description of Artificial Sequence: Synthetic polypeptide
RLRKCYEAGMTLGARKLKKLGNLKLQEEGEASSTTSPTEE

SEQ ID NO: 5044 - protein, 40 aa, Artificial Sequence
  Description of Artificial Sequence: Synthetic polypeptide
RKCYEAGMTLGARKLKKLGNLKLQEEGEASSTTSPTEETT

SEQ ID NO: 5045 - protein, 40 aa, Artificial Sequence
  Description of Artificial Sequence: Synthetic polypeptide
KCYEAGMTLGARKLKKLGNLKLQEEGEASSTTSPTEETTQ

SEQ ID NO: 5046 - protein, 40 aa, Artificial Sequence
  Description of Artificial Sequence: Synthetic polypeptide
CYEAGMTLGARKLKKLGNLKLQEEGEASSTTSPTEETTQK

SEQ ID NO: 5047 - protein, 40 aa, Artificial Sequence
  Description of Artificial Sequence: Synthetic polypeptide
YEAGMTLGARKLKKLGNLKLQEEGEASSTTSPTEETTQKL

SEQ ID NO: 5048 - protein, 40 aa, Artificial Sequence
  Description of Artificial Sequence: Synthetic polypeptide
EAGMTLGARKLKKLGNLKLQEEGEASSTTSPTEETTQKLT

SEQ ID NO: 5049 - protein, 40 aa, Artificial Sequence
  Description of Artificial Sequence: Synthetic polypeptide
GMTLGARKLKKLGNLKLQEEGEASSTTSPTEETTQKLTVS

SEQ ID NO: 5050 - protein, 40 aa, Artificial Sequence
  Description of Artificial Sequence: Synthetic polypeptide
MGARKLKKLGNLKLQEEGEASSTTSPTEETTQKLTVSHIE

SEQ ID NO: 5051 - protein, 40 aa, Artificial Sequence
  Description of Artificial Sequence: Synthetic polypeptide
GARKLKKLGNLKLQEEGEASSTTSPTEETTQKLTVSHIEG

SEQ ID NO: 5052 - protein, 40 aa, Artificial Sequence
  Description of Artificial Sequence: Synthetic polypeptide
KLKKLGNLKLQEEGEASSTTSPTEETTQKLTVSHIEGYEC

SEQ ID NO: 5053 - protein, 40 aa, Artificial Sequence
  Description of Artificial Sequence: Synthetic polypeptide
KKLGNLKLQEEGEASSTTSPTEETTQKLTVSHIEGYECQP

SEQ ID NO: 5054 - protein, 40 aa, Artificial Sequence
  Description of Artificial Sequence: Synthetic polypeptide
LFSIIPVDGLKNQKFFDELRMNYIKELDRIIACKRKNPTS

SEQ ID NO: 5055 - protein, 40 aa, Artificial Sequence
  Description of Artificial Sequence: Synthetic polypeptide
FSIIPVDGLKNQKFFDELRMNYIKELDRIIACKRKNPTSC

SEQ ID NO: 5056 - protein, 40 aa, Artificial Sequence
  Description of Artificial Sequence: Synthetic polypeptide
SIIPVDGLKNQKFFDELRMNYIKELDRIIACKRKNPTSCS

SEQ ID NO: 5057 - protein, 40 aa, Artificial Sequence
  Description of Artificial Sequence: Synthetic polypeptide
IIPVDGLKNQKFFDELRMNYIKELDRIIACKRKNPTSCSR

SEQ ID NO: 5058 - protein, 40 aa, Artificial Sequence
  Description of Artificial Sequence: Synthetic polypeptide
IPVDGLKNQKFFDELRMNYIKELDRIIACKRKNPTSCSRR

SEQ ID NO: 5059 - protein, 40 aa, Artificial Sequence
  Description of Artificial Sequence: Synthetic polypeptide
PVDGLKNQKFFDELRMNYIKELDRIIACKRKNPTSCSRRF

SEQ ID NO: 5060 - protein, 40 aa, Artificial Sequence
  Description of Artificial Sequence: Synthetic polypeptide
VDGLKNQKFFDELRMNYIKELDRIIACKRKNPTSCSRRFY

SEQ ID NO: 5061 - protein, 40 aa, Artificial Sequence
  Description of Artificial Sequence: Synthetic polypeptide
DGLKNQKFFDELRMNYIKELDRIIACKRKNPTSCSRRFYQ

SEQ ID NO: 5062 - protein, 40 aa, Artificial Sequence
  Description of Artificial Sequence: Synthetic polypeptide
GLKNQKFFDELRMNYIKELDRIIACKRKNPTSCSRRFYQL

SEQ ID NO: 5063 - protein, 40 aa, Artificial Sequence
  Description of Artificial Sequence: Synthetic polypeptide
QKFFDELRMNYIKELDRIIACKRKNPTSCSRRFYQLTKLL

SEQ ID NO: 5064 - protein, 40 aa, Artificial Sequence
  Description of Artificial Sequence: Synthetic polypeptide
KFFDELRMNYIKELDRIIACKRKNPTSCSRRFYQLTKLLD

SEQ ID NO: 5065 - protein, 40 aa, Artificial Sequence
  Description of Artificial Sequence: Synthetic polypeptide
FFDELRMNYIKELDRIIACKRKNPTSCSRRFYQLTKLLDS

SEQ ID NO: 5066 - protein, 40 aa, Artificial Sequence
  Description of Artificial Sequence: Synthetic polypeptide
FDELRMNYIKELDRIIACKRKNPTSCSRRFYQLTKLLDSV

SEQ ID NO: 5067 - protein, 40 aa, Artificial Sequence
  Description of Artificial Sequence: Synthetic polypeptide
DELRMNYIKELDRIIACKRKNPTSCSRRFYQLTKLLDSVQ

SEQ ID NO: 5068 - protein, 40 aa, Artificial Sequence
  Description of Artificial Sequence: Synthetic polypeptide
ELRMNYIKELDRIIACKRKNPTSCSRRFYQLTKLLDSVQP

SEQ ID NO: 5069 - protein, 40 aa, Artificial Sequence
  Description of Artificial Sequence: Synthetic polypeptide
RMNYIKELDRIIACKRKNPTSCSRRFYQLTKLLDSVQPIA

SEQ ID NO: 5070 - protein, 40 aa, Artificial Sequence
  Description of Artificial Sequence: Synthetic polypeptide
DRIIACKRKNPTSCSRRFYQLTKLLDSVQPIARELHQFTF

SEQ ID NO: 5071 - protein, 40 aa, Artificial Sequence
  Description of Artificial Sequence: Synthetic polypeptide
IIACKRKNPTSCSRRFYQLTKLLDSVQPIARELHQFTFDL

SEQ ID NO: 5072 - protein, 40 aa, Artificial Sequence
  Description of Artificial Sequence: Synthetic polypeptide
KRKNPTSCSRRFYQLTKLLDSVQPIARELHQFTFDLLIKS

SEQ ID NO: 5073 - protein, 40 aa, Artificial Sequence
  Description of Artificial Sequence: Synthetic polypeptide
TSCSRRFYQLTKLLDSVQPIARELHQFTFDLLIKSHMVSV

SEQ ID NO: 5074 - protein, 40 aa, Artificial Sequence
  Description of Artificial Sequence: Synthetic polypeptide
PANGAEPSRAVGTVKVYLPNKQRTVVTVRDGMSVYDSLDK

SEQ ID NO: 5075 - protein, 40 aa, Artificial Sequence
  Description of Artificial Sequence: Synthetic polypeptide
MAFCDFCLKFLFHGFRCQTCGYKFHQHCSSKVPTVCVDMS

SEQ ID NO: 5076 - protein, 40 aa, Artificial Sequence
  Description of Artificial Sequence: Synthetic polypeptide
AFCDFCLKFLFHGFRCQTCGYKFHQHCSSKVPTVCVDMST

SEQ ID NO: 5077 - protein, 40 aa, Artificial Sequence
  Description of Artificial Sequence: Synthetic polypeptide
RKSPHSKSPAEQRERKSLADDKKKVKNLGYRDSGYYWEVP

SEQ ID NO: 5078 - protein, 40 aa, Artificial Sequence
  Description of Artificial Sequence: Synthetic polypeptide
SPHSKSPAEQRERKSLADDKKKVKNLGYRDSGYYWEVPPS

SEQ ID NO: 5079 - protein, 40 aa, Artificial Sequence
  Description of Artificial Sequence: Synthetic polypeptide
GSFGTVFRGRWHGDVAVKVLKVSQPTAEQAQAFKNEMQVL

SEQ ID NO: 5080 - protein, 40 aa, Artificial Sequence
  Description of Artificial Sequence: Synthetic polypeptide
SFGTVFRGRWHGDVAVKVLKVSQPTAEQAQAFKNEMQVLR

SEQ ID NO: 5081 - protein, 40 aa, Artificial Sequence
  Description of Artificial Sequence: Synthetic polypeptide
FGTVFRGRWHGDVAVKVLKVSQPTAEQAQAFKNEMQVLRK

SEQ ID NO: 5082 - protein, 40 aa, Artificial Sequence
  Description of Artificial Sequence: Synthetic polypeptide
YAYGVVLYELMTGSLPYSHIGCRDQIIFMVGRGYLSPDLS

SEQ ID NO: 5083 - protein, 40 aa, Artificial Sequence
  Description of Artificial Sequence: Synthetic polypeptide
MTGSLPYSHIGCRDQIIFMVGRGYLSPDLSKISSNCPKAM

SEQ ID NO: 5084 - protein, 40 aa, Artificial Sequence
  Description of Artificial Sequence: Synthetic polypeptide
PYSHIGCRDQIIFMVGRGYLSPDLSKISSNCPKAMRRLLS

SEQ ID NO: 5085 - protein, 40 aa, Artificial Sequence
  Description of Artificial Sequence: Synthetic polypeptide
AGAAASSAADPAIPEEVWNIKQMIKLTQEHIEALLDKFGG

SEQ ID NO: 5086 - protein, 40 aa, Artificial Sequence
  Description of Artificial Sequence: Synthetic polypeptide
GAAASSAADPAIPEEVWNIKQMIKLTQEHIEALLDKFGGE

SEQ ID NO: 5087 - protein, 40 aa, Artificial Sequence
  Description of Artificial Sequence: Synthetic polypeptide
AAASSAADPAIPEEVWNIKQMIKLTQEHIEALLDKFGGEH

SEQ ID NO: 5088 - protein, 40 aa, Artificial Sequence
  Description of Artificial Sequence: Synthetic polypeptide
AASSAADPAIPEEVWNIKQMIKLTQEHIEALLDKFGGEHN

SEQ ID NO: 5089 - protein, 40 aa, Artificial Sequence
  Description of Artificial Sequence: Synthetic polypeptide
ASSAADPAIPEEVWNIKQMIKLTQEHIEALLDKFGGEHNP

SEQ ID NO: 5090 - protein, 40 aa, Artificial Sequence
  Description of Artificial Sequence: Synthetic polypeptide
DPAIPEEVWNIKQMIKLTQEHIEALLDKFGGEHNPPSIYL

SEQ ID NO: 5091 - protein, 40 aa, Artificial Sequence
  Description of Artificial Sequence: Synthetic polypeptide
WNIKQMIKLTQEHIEALLDKFGGEHNPPSIYLEAYEEYTS

SEQ ID NO: 5092 - protein, 40 aa, Artificial Sequence
  Description of Artificial Sequence: Synthetic polypeptide
KQMIKLTQEHIEALLDKFGGEHNPPSIYLEAYEEYTSKLD

SEQ ID NO: 5093 - protein, 40 aa, Artificial Sequence
  Description of Artificial Sequence: Synthetic polypeptide
MDKFGGEHNPPSIYLEAYEEYTSKLDALQQREQQLLESLG

SEQ ID NO: 5094 - protein, 40 aa, Artificial Sequence
  Description of Artificial Sequence: Synthetic polypeptide
EQQLLESLGNGTDFSVSSSASMDTVTSSSSSSLSVLPSSL

SEQ ID NO: 5095 - protein, 40 aa, Artificial Sequence
  Description of Artificial Sequence: Synthetic polypeptide
QQLLESLGNGTDFSVSSSASMDTVTSSSSSSLSVLPSSLS

SEQ ID NO: 5096 - protein, 40 aa, Artificial Sequence
  Description of Artificial Sequence: Synthetic polypeptide
QLLESLGNGTDFSVSSSASMDTVTSSSSSSLSVLPSSLSV

SEQ ID NO: 5097 - protein, 40 aa, Artificial Sequence
  Description of Artificial Sequence: Synthetic polypeptide
LLESLGNGTDFSVSSSASMDTVTSSSSSSLSVLPSSLSVF

SEQ ID NO: 5098 - protein, 40 aa, Artificial Sequence
  Description of Artificial Sequence: Synthetic polypeptide
MESLGNGTDFSVSSSASMDTVTSSSSSSLSVLPSSLSVFQ

SEQ ID NO: 5099 - protein, 40 aa, Artificial Sequence
  Description of Artificial Sequence: Synthetic polypeptide
MGNGTDFSVSSSASMDTVTSSSSSSLSVLPSSLSVFQNPT

SEQ ID NO: 5100 - protein, 40 aa, Artificial Sequence
  Description of Artificial Sequence: Synthetic polypeptide
NGTDFSVSSSASMDTVTSSSSSSLSVLPSSLSVFQNPTDV

SEQ ID NO: 5101 - protein, 40 aa, Artificial Sequence
  Description of Artificial Sequence: Synthetic polypeptide
GTDFSVSSSASMDTVTSSSSSSLSVLPSSLSVFQNPTDVA

SEQ ID NO: 5102 - protein, 40 aa, Artificial Sequence
  Description of Artificial Sequence: Synthetic polypeptide
TDFSVSSSASMDTVTSSSSSSLSVLPSSLSVFQNPTDVAR

SEQ ID NO: 5103 - protein, 40 aa, Artificial Sequence
  Description of Artificial Sequence: Synthetic polypeptide
FSVSSSASMDTVTSSSSSSLSVLPSSLSVFQNPTDVARSN

SEQ ID NO: 5104 - protein, 40 aa, Artificial Sequence
  Description of Artificial Sequence: Synthetic polypeptide
SVSSSASMDTVTSSSSSSLSVLPSSLSVFQNPTDVARSNP

SEQ ID NO: 5105 - protein, 40 aa, Artificial Sequence
  Description of Artificial Sequence: Synthetic polypeptide
ASMDTVTSSSSSSLSVLPSSLSVFQNPTDVARSNPKSPQK

SEQ ID NO: 5106 - protein, 40 aa, Artificial Sequence
  Description of Artificial Sequence: Synthetic polypeptide
DTVTSSSSSSLSVLPSSLSVFQNPTDVARSNPKSPQKPIV

SEQ ID NO: 5107 - protein, 40 aa, Artificial Sequence
  Description of Artificial Sequence: Synthetic polypeptide
TVTSSSSSSLSVLPSSLSVFQNPTDVARSNPKSPQKPIVR

SEQ ID NO: 5108 - protein, 40 aa, Artificial Sequence
  Description of Artificial Sequence: Synthetic polypeptide
SSSSSSLSVLPSSLSVFQNPTDVARSNPKSPQKPIVRVFL

SEQ ID NO: 5109 - protein, 40 aa, Artificial Sequence
  Description of Artificial Sequence: Synthetic polypeptide
VARSNPKSPQKPIVRVFLPNKQRTVVPARCGVTVRDSLKK

SEQ ID NO: 5110 - protein, 40 aa, Artificial Sequence
  Description of Artificial Sequence: Synthetic polypeptide
LTGEELHVEVLENVPLTTHNFVRKTFFTLAFCDFCRKLLF

SEQ ID NO: 5111 - protein, 40 aa, Artificial Sequence
  Description of Artificial Sequence: Synthetic polypeptide
MHVEVLENVPLTTHNFVRKTFFTLAFCDFCRKLLFQGFRC

SEQ ID NO: 5112 - protein, 40 aa, Artificial Sequence
  Description of Artificial Sequence: Synthetic polypeptide
HVEVLENVPLTTHNFVRKTFFTLAFCDFCRKLLFQGFRCQ

SEQ ID NO: 5113 - protein, 40 aa, Artificial Sequence
  Description of Artificial Sequence: Synthetic polypeptide
ENVPLTTHNFVRKTFFTLAFCDFCRKLLFQGFRCQTCGYK

SEQ ID NO: 5114 - protein, 40 aa, Artificial Sequence
  Description of Artificial Sequence: Synthetic polypeptide
VPLTTHNFVRKTFFTLAFCDFCRKLLFQGFRCQTCGYKFH

SEQ ID NO: 5115 - protein, 40 aa, Artificial Sequence
  Description of Artificial Sequence: Synthetic polypeptide
LTTHNFVRKTFFTLAFCDFCRKLLFQGFRCQTCGYKFHQR

SEQ ID NO: 5116 - protein, 40 aa, Artificial Sequence
  Description of Artificial Sequence: Synthetic polypeptide
TTHNFVRKTFFTLAFCDFCRKLLFQGFRCQTCGYKFHQRC

SEQ ID NO: 5117 - protein, 40 aa, Artificial Sequence
  Description of Artificial Sequence: Synthetic polypeptide
KTFFTLAFCDFCRKLLFQGFRCQTCGYKFHQRCSTEVPLM

SEQ ID NO: 5118 - protein, 40 aa, Artificial Sequence
  Description of Artificial Sequence: Synthetic polypeptide
TFFTLAFCDFCRKLLFQGFRCQTCGYKFHQRCSTEVPLMC

SEQ ID NO: 5119 - protein, 40 aa, Artificial Sequence
  Description of Artificial Sequence: Synthetic polypeptide
FFTLAFCDFCRKLLFQGFRCQTCGYKFHQRCSTEVPLMCV

SEQ ID NO: 5120 - protein, 40 aa, Artificial Sequence
  Description of Artificial Sequence: Synthetic polypeptide
FTLAFCDFCRKLLFQGFRCQTCGYKFHQRCSTEVPLMCVN

SEQ ID NO: 5121 - protein, 40 aa, Artificial Sequence
  Description of Artificial Sequence: Synthetic polypeptide
AFCDFCRKLLFQGFRCQTCGYKFHQRCSTEVPLMCVNYDQ

SEQ ID NO: 5122 - protein, 40 aa, Artificial Sequence
  Description of Artificial Sequence: Synthetic polypeptide
CDFCRKLLFQGFRCQTCGYKFHQRCSTEVPLMCVNYDQLD

SEQ ID NO: 5123 - protein, 40 aa, Artificial Sequence
  Description of Artificial Sequence: Synthetic polypeptide
DFCRKLLFQGFRCQTCGYKFHQRCSTEVPLMCVNYDQLDL

SEQ ID NO: 5124 - protein, 40 aa, Artificial Sequence
  Description of Artificial Sequence: Synthetic polypeptide
FCRKLLFQGFRCQTCGYKFHQRCSTEVPLMCVNYDQLDLL

SEQ ID NO: 5125 - protein, 40 aa, Artificial Sequence
  Description of Artificial Sequence: Synthetic polypeptide
CRKLLFQGFRCQTCGYKFHQRCSTEVPLMCVNYDQLDLLF

SEQ ID NO: 5126 - protein, 40 aa, Artificial Sequence
  Description of Artificial Sequence: Synthetic polypeptide
RKLLFQGFRCQTCGYKFHQRCSTEVPLMCVNYDQLDLLFV

SEQ ID NO: 5127 - protein, 40 aa, Artificial Sequence
  Description of Artificial Sequence: Synthetic polypeptide
KLLFQGFRCQTCGYKFHQRCSTEVPLMCVNYDQLDLLFVS

SEQ ID NO: 5128 - protein, 40 aa, Artificial Sequence
  Description of Artificial Sequence: Synthetic polypeptide
MLFQGFRCQTCGYKFHQRCSTEVPLMCVNYDQLDLLFVSK

SEQ ID NO: 5129 - protein, 40 aa, Artificial Sequence
  Description of Artificial Sequence: Synthetic polypeptide
LFQGFRCQTCGYKFHQRCSTEVPLMCVNYDQLDLLFVSKF

SEQ ID NO: 5130 - protein, 40 aa, Artificial Sequence
  Description of Artificial Sequence: Synthetic polypeptide
FQGFRCQTCGYKFHQRCSTEVPLMCVNYDQLDLLFVSKFF

SEQ ID NO: 5131 - protein, 40 aa, Artificial Sequence
  Description of Artificial Sequence: Synthetic polypeptide
QGFRCQTCGYKFHQRCSTEVPLMCVNYDQLDLLFVSKFFE

SEQ ID NO: 5132 - protein, 40 aa, Artificial Sequence
  Description of Artificial Sequence: Synthetic polypeptide
CQTCGYKFHQRCSTEVPLMCVNYDQLDLLFVSKFFEHHPI

SEQ ID NO: 5133 - protein, 40 aa, Artificial Sequence
  Description of Artificial Sequence: Synthetic polypeptide
TCGYKFHQRCSTEVPLMCVNYDQLDLLFVSKFFEHHPIPQ

SEQ ID NO: 5134 - protein, 40 aa, Artificial Sequence
  Description of Artificial Sequence: Synthetic polypeptide
RDRSSSAPNVHINTIEPVNIDDLIRDQGFRGDGGSTTGLS

SEQ ID NO: 5135 - protein, 40 aa, Artificial Sequence
  Description of Artificial Sequence: Synthetic polypeptide
DRSSSAPNVHINTIEPVNIDDLIRDQGFRGDGGSTTGLSA

SEQ ID NO: 5136 - protein, 40 aa, Artificial Sequence
  Description of Artificial Sequence: Synthetic polypeptide
SSAPNVHINTIEPVNIDDLIRDQGFRGDGGSTTGLSATPP

SEQ ID NO: 5137 - protein, 40 aa, Artificial Sequence
  Description of Artificial Sequence: Synthetic polypeptide
SAPNVHINTIEPVNIDDLIRDQGFRGDGGSTTGLSATPPA

SEQ ID NO: 5138 - protein, 40 aa, Artificial Sequence
  Description of Artificial Sequence: Synthetic polypeptide
APNVHINTIEPVNIDDLIRDQGFRGDGGSTTGLSATPPAS

SEQ ID NO: 5139 - protein, 40 aa, Artificial Sequence
  Description of Artificial Sequence: Synthetic polypeptide
PNVHINTIEPVNIDDLIRDQGFRGDGGSTTGLSATPPASL

SEQ ID NO: 5140 - protein, 40 aa, Artificial Sequence
  Description of Artificial Sequence: Synthetic polypeptide
NVHINTIEPVNIDDLIRDQGFRGDGGSTTGLSATPPASLP

SEQ ID NO: 5141 - protein, 40 aa, Artificial Sequence
  Description of Artificial Sequence: Synthetic polypeptide
VHINTIEPVNIDDLIRDQGFRGDGGSTTGLSATPPASLPG

SEQ ID NO: 5142 - protein, 40 aa, Artificial Sequence
  Description of Artificial Sequence: Synthetic polypeptide
HINTIEPVNIDDLIRDQGFRGDGGSTTGLSATPPASLPGS

SEQ ID NO: 5143 - protein, 40 aa, Artificial Sequence
  Description of Artificial Sequence: Synthetic polypeptide
INTIEPVNIDDLIRDQGFRGDGGSTTGLSATPPASLPGSL

SEQ ID NO: 5144 - protein, 40 aa, Artificial Sequence
  Description of Artificial Sequence: Synthetic polypeptide
EPVNIDDLIRDQGFRGDGGSTTGLSATPPASLPGSLTNVK

SEQ ID NO: 5145 - protein, 40 aa, Artificial Sequence
  Description of Artificial Sequence: Synthetic polypeptide
NIDDLIRDQGFRGDGGSTTGLSATPPASLPGSLTNVKALQ

SEQ ID NO: 5146 - protein, 40 aa, Artificial Sequence
  Description of Artificial Sequence: Synthetic polypeptide
DQGFRGDGGSTTGLSATPPASLPGSLTNVKALQKSPGPQR

SEQ ID NO: 5147 - protein, 40 aa, Artificial Sequence
  Description of Artificial Sequence: Synthetic polypeptide
QGFRGDGGSTTGLSATPPASLPGSLTNVKALQKSPGPQRE

SEQ ID NO: 5148 - protein, 40 aa, Artificial Sequence
  Description of Artificial Sequence: Synthetic polypeptide
FRGDGGSTTGLSATPPASLPGSLTNVKALQKSPGPQRERK

SEQ ID NO: 5149 - protein, 40 aa, Artificial Sequence
  Description of Artificial Sequence: Synthetic polypeptide
GDGGSTTGLSATPPASLPGSLTNVKALQKSPGPQRERKSS

SEQ ID NO: 5150 - protein, 40 aa, Artificial Sequence
  Description of Artificial Sequence: Synthetic polypeptide
GGSTTGLSATPPASLPGSLTNVKALQKSPGPQRERKSSSS

SEQ ID NO: 5151 - protein, 40 aa, Artificial Sequence
  Description of Artificial Sequence: Synthetic polypeptide
GSTTGLSATPPASLPGSLTNVKALQKSPGPQRERKSSSSS

SEQ ID NO: 5152 - protein, 40 aa, Artificial Sequence
  Description of Artificial Sequence: Synthetic polypeptide
TTGLSATPPASLPGSLTNVKALQKSPGPQRERKSSSSSED

SEQ ID NO: 5153 - protein, 40 aa, Artificial Sequence
  Description of Artificial Sequence: Synthetic polypeptide
MGYSTKPQLAIVTQWCEGSSLYHHLHIIETKFEMIKLIDI

SEQ ID NO: 5154 - protein, 40 aa, Artificial Sequence
  Description of Artificial Sequence: Synthetic polypeptide
YSTKPQLAIVTQWCEGSSLYHHLHIIETKFEMIKLIDIAR

SEQ ID NO: 5155 - protein, 40 aa, Artificial Sequence
  Description of Artificial Sequence: Synthetic polypeptide
HIIETKFEMIKLIDIARQTAQGMDYLHAKSIIHRDLKSNN

SEQ ID NO: 5156 - protein, 40 aa, Artificial Sequence
  Description of Artificial Sequence: Synthetic polypeptide
IIETKFEMIKLIDIARQTAQGMDYLHAKSIIHRDLKSNNI

SEQ ID NO: 5157 - protein, 40 aa, Artificial Sequence
  Description of Artificial Sequence: Synthetic polypeptide
LIDIARQTAQGMDYLHAKSIIHRDLKSNNIFLHEDLTVKI

SEQ ID NO: 5158 - protein, 40 aa, Artificial Sequence
  Description of Artificial Sequence: Synthetic polypeptide
IARQTAQGMDYLHAKSIIHRDLKSNNIFLHEDLTVKIGDF

SEQ ID NO: 5159 - protein, 40 aa, Artificial Sequence
  Description of Artificial Sequence: Synthetic polypeptide
AQGMDYLHAKSIIHRDLKSNNIFLHEDLTVKIGDFGLATV

SEQ ID NO: 5160 - protein, 40 aa, Artificial Sequence
  Description of Artificial Sequence: Synthetic polypeptide
QGMDYLHAKSIIHRDLKSNNIFLHEDLTVKIGDFGLATVK

SEQ ID NO: 5161 - protein, 40 aa, Artificial Sequence
  Description of Artificial Sequence: Synthetic polypeptide
MDYLHAKSIIHRDLKSNNIFLHEDLTVKIGDFGLATVKSR

SEQ ID NO: 5162 - protein, 40 aa, Artificial Sequence
  Description of Artificial Sequence: Synthetic polypeptide
IHRDLKSNNIFLHEDLTVKIGDFGLATVKSRWSGSHQFEQ

SEQ ID NO: 5163 - protein, 40 aa, Artificial Sequence
  Description of Artificial Sequence: Synthetic polypeptide
HRDLKSNNIFLHEDLTVKIGDFGLATVKSRWSGSHQFEQL

SEQ ID NO: 5164 - protein, 40 aa, Artificial Sequence
  Description of Artificial Sequence: Synthetic polypeptide
RDLKSNNIFLHEDLTVKIGDFGLATVKSRWSGSHQFEQLS

SEQ ID NO: 5165 - protein, 40 aa, Artificial Sequence
  Description of Artificial Sequence: Synthetic polypeptide
SNNIFLHEDLTVKIGDFGLATVKSRWSGSHQFEQLSGSIL

SEQ ID NO: 5166 - protein, 40 aa, Artificial Sequence
  Description of Artificial Sequence: Synthetic polypeptide
NNIFLHEDLTVKIGDFGLATVKSRWSGSHQFEQLSGSILW

SEQ ID NO: 5167 - protein, 40 aa, Artificial Sequence
  Description of Artificial Sequence: Synthetic polypeptide
IGDFGLATVKSRWSGSHQFEQLSGSILWMAPEVIRMQDKN

SEQ ID NO: 5168 - protein, 40 aa, Artificial Sequence
  Description of Artificial Sequence: Synthetic polypeptide
DKNPYSFQSDVYAFGIVLYELMTGQLPYSNINNRDQIIFM

SEQ ID NO: 5169 - protein, 40 aa, Artificial Sequence
  Description of Artificial Sequence: Synthetic polypeptide
SFQSDVYAFGIVLYELMTGQLPYSNINNRDQIIFMVGRGY

SEQ ID NO: 5170 - protein, 40 aa, Artificial Sequence
  Description of Artificial Sequence: Synthetic polypeptide
QSDVYAFGIVLYELMTGQLPYSNINNRDQIIFMVGRGYLS

SEQ ID NO: 5171 - protein, 40 aa, Artificial Sequence
  Description of Artificial Sequence: Synthetic polypeptide
VYAFGIVLYELMTGQLPYSNINNRDQIIFMVGRGYLSPDL

SEQ ID NO: 5172 - protein, 40 aa, Artificial Sequence
  Description of Artificial Sequence: Synthetic polypeptide
AFGIVLYELMTGQLPYSNINNRDQIIFMVGRGYLSPDLSK

SEQ ID NO: 5173 - protein, 40 aa, Artificial Sequence
  Description of Artificial Sequence: Synthetic polypeptide
GIVLYELMTGQLPYSNINNRDQIIFMVGRGYLSPDLSKVR

SEQ ID NO: 5174 - protein, 40 aa, Artificial Sequence
  Description of Artificial Sequence: Synthetic polypeptide
IVLYELMTGQLPYSNINNRDQIIFMVGRGYLSPDLSKVRS

SEQ ID NO: 5175 - protein, 40 aa, Artificial Sequence
  Description of Artificial Sequence: Synthetic polypeptide
VLYELMTGQLPYSNINNRDQIIFMVGRGYLSPDLSKVRSN

SEQ ID NO: 5176 - protein, 40 aa, Artificial Sequence
  Description of Artificial Sequence: Synthetic polypeptide
MYELMTGQLPYSNINNRDQIIFMVGRGYLSPDLSKVRSNC

SEQ ID NO: 5177 - protein, 40 aa, Artificial Sequence
  Description of Artificial Sequence: Synthetic polypeptide
YELMTGQLPYSNINNRDQIIFMVGRGYLSPDLSKVRSNCP

SEQ ID NO: 5178 - protein, 40 aa, Artificial Sequence
  Description of Artificial Sequence: Synthetic polypeptide
MMTGQLPYSNINNRDQIIFMVGRGYLSPDLSKVRSNCPKA

SEQ ID NO: 5179 - protein, 40 aa, Artificial Sequence
  Description of Artificial Sequence: Synthetic polypeptide
QLPYSNINNRDQIIFMVGRGYLSPDLSKVRSNCPKAMKRL

SEQ ID NO: 5180 - protein, 40 aa, Artificial Sequence
  Description of Artificial Sequence: Synthetic polypeptide
LPYSNINNRDQIIFMVGRGYLSPDLSKVRSNCPKAMKRLM

SEQ ID NO: 5181 - protein, 40 aa, Artificial Sequence
  Description of Artificial Sequence: Synthetic polypeptide
INNRDQIIFMVGRGYLSPDLSKVRSNCPKAMKRLMAECLK

SEQ ID NO: 5182 - protein, 40 aa, Artificial Sequence
  Description of Artificial Sequence: Synthetic polypeptide
IFMVGRGYLSPDLSKVRSNCPKAMKRLMAECLKKKRDERP

SEQ ID NO: 5183 - protein, 40 aa, Artificial Sequence
  Description of Artificial Sequence: Synthetic polypeptide
RGYLSPDLSKVRSNCPKAMKRLMAECLKKKRDERPLFPQI

SEQ ID NO: 5184 - protein, 40 aa, Artificial Sequence
  Description of Artificial Sequence: Synthetic polypeptide
SPDLSKVRSNCPKAMKRLMAECLKKKRDERPLFPQILASI

SEQ ID NO: 5185 - protein, 40 aa, Artificial Sequence
  Description of Artificial Sequence: Synthetic polypeptide
DLSKVRSNCPKAMKRLMAECLKKKRDERPLFPQILASIEL

SEQ ID NO: 5186 - protein, 40 aa, Artificial Sequence
  Description of Artificial Sequence: Synthetic polypeptide
ESNLSFLKELLFRINRLDLLITYLNTRKEEMERELQTPGR

SEQ ID NO: 5187 - protein, 40 aa, Artificial Sequence
  Description of Artificial Sequence: Synthetic polypeptide
DLLITYLNTRKEEMERELQTPGRAQISAYRVMLYQISEEV

SEQ ID NO: 5188 - protein, 40 aa, Artificial Sequence
  Description of Artificial Sequence: Synthetic polypeptide
MLITYLNTRKEEMERELQTPGRAQISAYRVMLYQISEEVS

SEQ ID NO: 5189 - protein, 40 aa, Artificial Sequence
  Description of Artificial Sequence: Synthetic polypeptide
MITYLNTRKEEMERELQTPGRAQISAYRVMLYQISEEVSR

SEQ ID NO: 5190 - protein, 40 aa, Artificial Sequence
  Description of Artificial Sequence: Synthetic polypeptide
TYLNTRKEEMERELQTPGRAQISAYRVMLYQISEEVSRSE

SEQ ID NO: 5191 - protein, 40 aa, Artificial Sequence
  Description of Artificial Sequence: Synthetic polypeptide
EEMERELQTPGRAQISAYRVMLYQISEEVSRSELRSFKFL

SEQ ID NO: 5192 - protein, 40 aa, Artificial Sequence
  Description of Artificial Sequence: Synthetic polypeptide
EMERELQTPGRAQISAYRVMLYQISEEVSRSELRSFKFLL

SEQ ID NO: 5193 - protein, 40 aa, Artificial Sequence
  Description of Artificial Sequence: Synthetic polypeptide
LQTPGRAQISAYRVMLYQISEEVSRSELRSFKFLLQEEIS

SEQ ID NO: 5194 - protein, 40 aa, Artificial Sequence
  Description of Artificial Sequence: Synthetic polypeptide
QTPGRAQISAYRVMLYQISEEVSRSELRSFKFLLQEEISK

SEQ ID NO: 5195 - protein, 40 aa, Artificial Sequence
  Description of Artificial Sequence: Synthetic polypeptide
AQISAYRVMLYQISEEVSRSELRSFKFLLQEEISKCKLDD

SEQ ID NO: 5196 - protein, 40 aa, Artificial Sequence
  Description of Artificial Sequence: Synthetic polypeptide
KLDDDMNLLDIFIEMEKRVILGEGKLDILKRVCAQINKSL

SEQ ID NO: 5197 - protein, 40 aa, Artificial Sequence
  Description of Artificial Sequence: Synthetic polypeptide
DDMNLLDIFIEMEKRVILGEGKLDILKRVCAQINKSLLKI

SEQ ID NO: 5198 - protein, 40 aa, Artificial Sequence
  Description of Artificial Sequence: Synthetic polypeptide
DIFIEMEKRVILGEGKLDILKRVCAQINKSLLKIINDYEE

SEQ ID NO: 5199 - protein, 40 aa, Artificial Sequence
  Description of Artificial Sequence: Synthetic polypeptide
IFIEMEKRVILGEGKLDILKRVCAQINKSLLKIINDYEEF

SEQ ID NO: 5200 - protein, 40 aa, Artificial Sequence
  Description of Artificial Sequence: Synthetic polypeptide
FIEMEKRVILGEGKLDILKRVCAQINKSLLKIINDYEEFS

SEQ ID NO: 5201 - protein, 40 aa, Artificial Sequence
  Description of Artificial Sequence: Synthetic polypeptide
EMEKRVILGEGKLDILKRVCAQINKSLLKIINDYEEFSKE

SEQ ID NO: 5202 - protein, 40 aa, Artificial Sequence
  Description of Artificial Sequence: Synthetic polypeptide
MEKRVILGEGKLDILKRVCAQINKSLLKIINDYEEFSKER

SEQ ID NO: 5203 - protein, 40 aa, Artificial Sequence
  Description of Artificial Sequence: Synthetic polypeptide
EKRVILGEGKLDILKRVCAQINKSLLKIINDYEEFSKERS

SEQ ID NO: 5204 - protein, 40 aa, Artificial Sequence
  Description of Artificial Sequence: Synthetic polypeptide
KRVILGEGKLDILKRVCAQINKSLLKIINDYEEFSKERSS

SEQ ID NO: 5205 - protein, 40 aa, Artificial Sequence
  Description of Artificial Sequence: Synthetic polypeptide
VILGEGKLDILKRVCAQINKSLLKIINDYEEFSKERSSSL

SEQ ID NO: 5206 - protein, 40 aa, Artificial Sequence
  Description of Artificial Sequence: Synthetic polypeptide
ILGEGKLDILKRVCAQINKSLLKIINDYEEFSKERSSSLE

SEQ ID NO: 5207 - protein, 40 aa, Artificial Sequence
  Description of Artificial Sequence: Synthetic polypeptide
GEGKLDILKRVCAQINKSLLKIINDYEEFSKERSSSLEGS

SEQ ID NO: 5208 - protein, 40 aa, Artificial Sequence
  Description of Artificial Sequence: Synthetic polypeptide
GKLDILKRVCAQINKSLLKIINDYEEFSKERSSSLEGSPD

SEQ ID NO: 5209 - protein, 40 aa, Artificial Sequence
  Description of Artificial Sequence: Synthetic polypeptide
KLDILKRVCAQINKSLLKIINDYEEFSKERSSSLEGSPDE

SEQ ID NO: 5210 - protein, 40 aa, Artificial Sequence
  Description of Artificial Sequence: Synthetic polypeptide
DILKRVCAQINKSLLKIINDYEEFSKERSSSLEGSPDEFS

SEQ ID NO: 5211 - protein, 40 aa, Artificial Sequence
  Description of Artificial Sequence: Synthetic polypeptide
ILKRVCAQINKSLLKIINDYEEFSKERSSSLEGSPDEFSN

SEQ ID NO: 5212 - protein, 40 aa, Artificial Sequence
  Description of Artificial Sequence: Synthetic polypeptide
QINKSLLKIINDYEEFSKERSSSLEGSPDEFSNGEELCGV

SEQ ID NO: 5213 - protein, 40 aa, Artificial Sequence
  Description of Artificial Sequence: Synthetic polypeptide
SIRDRNGTHLDAGALTTTFEELHFEIKPHDDCTVEQIYEI

SEQ ID NO: 5214 - protein, 40 aa, Artificial Sequence
  Description of Artificial Sequence: Synthetic polypeptide
NGTHLDAGALTTTFEELHFEIKPHDDCTVEQIYEILKIYQ

SEQ ID NO: 5215 - protein, 40 aa, Artificial Sequence
  Description of Artificial Sequence: Synthetic polypeptide
GTHLDAGALTTTFEELHFEIKPHDDCTVEQIYEILKIYQL

SEQ ID NO: 5216 - protein, 40 aa, Artificial Sequence
  Description of Artificial Sequence: Synthetic polypeptide
SHGDKGIIYGTDGQEAPIYELTSQFTGLKCPSLAGKPKVF

SEQ ID NO: 5217 - protein, 40 aa, Artificial Sequence
  Description of Artificial Sequence: Synthetic polypeptide
GDKGIIYGTDGQEAPIYELTSQFTGLKCPSLAGKPKVFFI

SEQ ID NO: 5218 - protein, 40 aa, Artificial Sequence
  Description of Artificial Sequence: Synthetic polypeptide
GIIYGTDGQEAPIYELTSQFTGLKCPSLAGKPKVFFIQAC

SEQ ID NO: 5219 - protein, 40 aa, Artificial Sequence
  Description of Artificial Sequence: Synthetic polypeptide
YGTDGQEAPIYELTSQFTGLKCPSLAGKPKVFFIQACQGD

SEQ ID NO: 5220 - protein, 40 aa, Artificial Sequence
  Description of Artificial Sequence: Synthetic polypeptide
GTDGQEAPIYELTSQFTGLKCPSLAGKPKVFFIQACQGDN

SEQ ID NO: 5221 - protein, 40 aa, Artificial Sequence; identical to SEQ ID NO: 2975
  Description of Artificial Sequence: Synthetic polypeptide

SEQ ID NO: 5222 - protein, 40 aa, Artificial Sequence
  Description of Artificial Sequence: Synthetic polypeptide
QEAPIYELTSQFTGLKCPSLAGKPKVFFIQACQGDNYQKG

SEQ ID NO: 5223 - protein, 40 aa, Artificial Sequence
  Description of Artificial Sequence: Synthetic polypeptide
ATVNNCVSYRNPAEGTWYIQSLCQSLRERCPRGDDILTIL

SEQ ID NO: 5224 - protein, 40 aa, Artificial Sequence
  Description of Artificial Sequence: Synthetic polypeptide
NPAEGTWYIQSLCQSLRERCPRGDDILTILTEVNYEVSNK

SEQ ID NO: 5225 - protein, 40 aa, Artificial Sequence
  Description of Artificial Sequence: Synthetic polypeptide
QSLRERCPRGDDILTILTEVNYEVSNKDDKKNMGKQMPQP

SEQ ID NO: 5226 - protein, 40 aa, Artificial Sequence
  Description of Artificial Sequence: Synthetic polypeptide
DILTILTEVNYEVSNKDDKKNMGKQMPQPTFTLRKKLVFP

SEQ ID NO: 5227 - protein, 40 aa, Artificial Sequence
  Description of Artificial Sequence: Synthetic polypeptide
ILTILTEVNYEVSNKDDKKNMGKQMPQPTFTLRKKLVFPS

SEQ ID NO: 5228 - protein, 40 aa, Artificial Sequence
  Description of Artificial Sequence: Synthetic polypeptide
LTILTEVNYEVSNKDDKKNMGKQMPQPTFTLRKKLVFPSD

SEQ ID NO: 5229 - protein, 40 aa, Artificial Sequence
  Description of Artificial Sequence: Synthetic polypeptide
RAYPDANLLNDRVLRAMLKAEETCAPSVSYFKCVQKEVLP

SEQ ID NO: 5230 - protein, 40 aa, Artificial Sequence
  Description of Artificial Sequence: Synthetic polypeptide
NDRVLRAMLKAEETCAPSVSYFKCVQKEVLPSMRKIVATW

SEQ ID NO: 5231 - protein, 40 aa, Artificial Sequence
  Description of Artificial Sequence: Synthetic polypeptide
MLEVCEEQKCEEEVFPLAMNYLDRFLSLEPVKKSRLQLLG

SEQ ID NO: 5232 - protein, 40 aa, Artificial Sequence
  Description of Artificial Sequence: Synthetic polypeptide
MEVCEEQKCEEEVFPLAMNYLDRFLSLEPVKKSRLQLLGA

SEQ ID NO: 5233 - protein, 40 aa, Artificial Sequence
  Description of Artificial Sequence: Synthetic polypeptide
EEQKCEEEVFPLAMNYLDRFLSLEPVKKSRLQLLGATCMF

SEQ ID NO: 5234 - protein, 40 aa, Artificial Sequence
  Description of Artificial Sequence: Synthetic polypeptide
QKCEEEVFPLAMNYLDRFLSLEPVKKSRLQLLGATCMFVA

SEQ ID NO: 5235 - protein, 40 aa, Artificial Sequence
  Description of Artificial Sequence: Synthetic polypeptide
FPLAMNYLDRFLSLEPVKKSRLQLLGATCMFVASKMKETI

SEQ ID NO: 5236 - protein, 40 aa, Artificial Sequence
  Description of Artificial Sequence: Synthetic polypeptide
PLAMNYLDRFLSLEPVKKSRLQLLGATCMFVASKMKETIP

SEQ ID NO: 5237 - protein, 40 aa, Artificial Sequence
  Description of Artificial Sequence: Synthetic polypeptide
MAMNYLDRFLSLEPVKKSRLQLLGATCMFVASKMKETIPL

SEQ ID NO: 5238 - protein, 40 aa, Artificial Sequence
  Description of Artificial Sequence: Synthetic polypeptide
MNYLDRFLSLEPVKKSRLQLLGATCMFVASKMKETIPLTA

SEQ ID NO: 5239 - protein, 40 aa, Artificial Sequence
  Description of Artificial Sequence: Synthetic polypeptide
NYLDRFLSLEPVKKSRLQLLGATCMFVASKMKETIPLTAE

SEQ ID NO: 5240 - protein, 40 aa, Artificial Sequence
  Description of Artificial Sequence: Synthetic polypeptide
YLDRFLSLEPVKKSRLQLLGATCMFVASKMKETIPLTAEK

SEQ ID NO: 5241 - protein, 40 aa, Artificial Sequence
  Description of Artificial Sequence: Synthetic polypeptide
MDRFLSLEPVKKSRLQLLGATCMFVASKMKETIPLTAEKL

SEQ ID NO: 5242 - protein, 40 aa, Artificial Sequence
  Description of Artificial Sequence: Synthetic polypeptide
DRFLSLEPVKKSRLQLLGATCMFVASKMKETIPLTAEKLC

SEQ ID NO: 5243 - protein, 40 aa, Artificial Sequence
  Description of Artificial Sequence: Synthetic polypeptide
MEPVKKSRLQLLGATCMFVASKMKETIPLTAEKLCIYTDN

SEQ ID NO: 5244 - protein, 40 aa, Artificial Sequence
  Description of Artificial Sequence: Synthetic polypeptide
EPVKKSRLQLLGATCMFVASKMKETIPLTAEKLCIYTDNS

SEQ ID NO: 5245 - protein, 40 aa, Artificial Sequence
  Description of Artificial Sequence: Synthetic polypeptide
PVKKSRLQLLGATCMFVASKMKETIPLTAEKLCIYTDNSI

SEQ ID NO: 5246 - protein, 40 aa, Artificial Sequence
  Description of Artificial Sequence: Synthetic polypeptide
VKKSRLQLLGATCMFVASKMKETIPLTAEKLCIYTDNSIR

SEQ ID NO: 5247 - protein, 40 aa, Artificial Sequence
  Description of Artificial Sequence: Synthetic polypeptide
KKSRLQLLGATCMFVASKMKETIPLTAEKLCIYTDNSIRP

SEQ ID NO: 5248 - protein, 40 aa, Artificial Sequence
  Description of Artificial Sequence: Synthetic polypeptide
VALCATDVKFISNPPSMVAAGSVVAAVQGLNLRSPNNFLS

SEQ ID NO: 5249 - protein, 40 aa, Artificial Sequence
  Description of Artificial Sequence: Synthetic polypeptide
SNPPSMVAAGSVVAAVQGLNLRSPNNFLSYYRLTRFLSRV

SEQ ID NO: 5250 - protein, 40 aa, Artificial Sequence
  Description of Artificial Sequence: Synthetic polypeptide
LRACQEQIEALLESSLRQAQQNMDPKAAEEEEEEEEEVDL

SEQ ID NO: 5251 - protein, 40 aa, Artificial Sequence
  Description of Artificial Sequence: Synthetic polypeptide
GPWSRSLSALLLLLQVSSWLCQEPEPCHPGFDAESYTFTV

SEQ ID NO: 5252 - protein, 40 aa, Artificial Sequence
  Description of Artificial Sequence: Synthetic polypeptide
SLSALLLLLQVSSWLCQEPEPCHPGFDAESYTFTVPRRHL

SEQ ID NO: 5253 - protein, 40 aa, Artificial Sequence
  Description of Artificial Sequence: Synthetic polypeptide
EPCHPGFDAESYTFTVPRRHLERGRVLGRVNFEDCTGRQR

SEQ ID NO: 5254 - protein, 40 aa, Artificial Sequence
  Description of Artificial Sequence: Synthetic polypeptide
RGRVLGRVNFEDCTGRQRTAYFSLDTRFKVGTDGVITVKR

SEQ ID NO: 5255 - protein, 40 aa, Artificial Sequence
  Description of Artificial Sequence: Synthetic polypeptide
YFSLDTRFKVGTDGVITVKRPLRFHNPQIHFLVYAWDSTY

SEQ ID NO: 5256 - protein, 40 aa, Artificial Sequence
  Description of Artificial Sequence: Synthetic polypeptide
HQASVSGIQAELLTFPNSSPGLRRQKRDWVIPPISCPENE

SEQ ID NO: 5257 - protein, 40 aa, Artificial Sequence
  Description of Artificial Sequence: Synthetic polypeptide
ELLTFPNSSPGLRRQKRDWVIPPISCPENEKGPFPKNLVQ

SEQ ID NO: 5258 - protein, 40 aa, Artificial Sequence
  Description of Artificial Sequence: Synthetic polypeptide
LTFPNSSPGLRRQKRDWVIPPISCPENEKGPFPKNLVQIK

SEQ ID NO: 5259 - protein, 40 aa, Artificial Sequence
  Description of Artificial Sequence: Synthetic polypeptide
TFPNSSPGLRRQKRDWVIPPISCPENEKGPFPKNLVQIKS

SEQ ID NO: 5260 - protein, 40 aa, Artificial Sequence
  Description of Artificial Sequence: Synthetic polypeptide
FPNSSPGLRRQKRDWVIPPISCPENEKGPFPKNLVQIKSN

SEQ ID NO: 5261 - protein, 40 aa, Artificial Sequence
  Description of Artificial Sequence: Synthetic polypeptide
SSPGLRRQKRDWVIPPISCPENEKGPFPKNLVQIKSNKDK

SEQ ID NO: 5262 - protein, 40 aa, Artificial Sequence
  Description of Artificial Sequence: Synthetic polypeptide
GLRRQKRDWVIPPISCPENEKGPFPKNLVQIKSNKDKEGK

SEQ ID NO: 5263 - protein, 40 aa, Artificial Sequence
  Description of Artificial Sequence: Synthetic polypeptide
LRRQKRDWVIPPISCPENEKGPFPKNLVQIKSNKDKEGKV

SEQ ID NO: 5264 - protein, 40 aa, Artificial Sequence
  Description of Artificial Sequence: Synthetic polypeptide
KRDWVIPPISCPENEKGPFPKNLVQIKSNKDKEGKVFYSI

SEQ ID NO: 5265 - protein, 40 aa, Artificial Sequence
  Description of Artificial Sequence: Synthetic polypeptide
RDWVIPPISCPENEKGPFPKNLVQIKSNKDKEGKVFYSIT

SEQ ID NO: 5266 - protein, 40 aa, Artificial Sequence
  Description of Artificial Sequence: Synthetic polypeptide
DWVIPPISCPENEKGPFPKNLVQIKSNKDKEGKVFYSITG

SEQ ID NO: 5267 - protein, 40 aa, Artificial Sequence
  Description of Artificial Sequence: Synthetic polypeptide
WVIPPISCPENEKGPFPKNLVQIKSNKDKEGKVFYSITGQ

SEQ ID NO: 5268 - protein, 40 aa, Artificial Sequence
  Description of Artificial Sequence: Synthetic polypeptide
IPPISCPENEKGPFPKNLVQIKSNKDKEGKVFYSITGQGA

SEQ ID NO: 5269 - protein, 40 aa, Artificial Sequence
  Description of Artificial Sequence: Synthetic polypeptide
PPISCPENEKGPFPKNLVQIKSNKDKEGKVFYSITGQGAD

SEQ ID NO: 5270 - protein, 40 aa, Artificial Sequence
  Description of Artificial Sequence: Synthetic polypeptide
ISCPENEKGPFPKNLVQIKSNKDKEGKVFYSITGQGADTP

SEQ ID NO: 5271 - protein, 40 aa, Artificial Sequence
  Description of Artificial Sequence: Synthetic polypeptide
SCPENEKGPFPKNLVQIKSNKDKEGKVFYSITGQGADTPP

SEQ ID NO: 5272 - protein, 40 aa, Artificial Sequence
  Description of Artificial Sequence: Synthetic polypeptide
CPENEKGPFPKNLVQIKSNKDKEGKVFYSITGQGADTPPV

SEQ ID NO: 5273 - protein, 40 aa, Artificial Sequence
  Description of Artificial Sequence: Synthetic polypeptide
PENEKGPFPKNLVQIKSNKDKEGKVFYSITGQGADTPPVG

SEQ ID NO: 5274 - protein, 40 aa, Artificial Sequence
  Description of Artificial Sequence: Synthetic polypeptide
ENEKGPFPKNLVQIKSNKDKEGKVFYSITGQGADTPPVGV

SEQ ID NO: 5275 - protein, 40 aa, Artificial Sequence
  Description of Artificial Sequence: Synthetic polypeptide
EKGPFPKNLVQIKSNKDKEGKVFYSITGQGADTPPVGVFI

SEQ ID NO: 5276 - protein, 40 aa, Artificial Sequence
  Description of Artificial Sequence: Synthetic polypeptide
KGPFPKNLVQIKSNKDKEGKVFYSITGQGADTPPVGVFII

SEQ ID NO: 5277 - protein, 40 aa, Artificial Sequence
  Description of Artificial Sequence: Synthetic polypeptide
GPFPKNLVQIKSNKDKEGKVFYSITGQGADTPPVGVFIIE

SEQ ID NO: 5278 - protein, 40 aa, Artificial Sequence
  Description of Artificial Sequence: Synthetic polypeptide
ITGQGADTPPVGVFIIERETGWLKVTEPLDRERIATYTLF

SEQ ID NO: 5279 - protein, 40 aa, Artificial Sequence
  Description of Artificial Sequence: Synthetic polypeptide
GQGADTPPVGVFIIERETGWLKVTEPLDRERIATYTLFSH

SEQ ID NO: 5280 - protein, 40 aa, Artificial Sequence
  Description of Artificial Sequence: Synthetic polypeptide
MEILITVTDQNDNKPEFTQEVFKGSVMEGALPGTSVMEVT

SEQ ID NO: 5281 - protein, 40 aa, Artificial Sequence
  Description of Artificial Sequence: Synthetic polypeptide
TINRNTGVISVVTTGLDRESFPTYTLVVQAADLQGEGLST

SEQ ID NO: 5282 - protein, 40 aa, Artificial Sequence
  Description of Artificial Sequence: Synthetic polypeptide
RNTGVISVVTTGLDRESFPTYTLVVQAADLQGEGLSTTAT

SEQ ID NO: 5283 - protein, 40 aa, Artificial Sequence
  Description of Artificial Sequence: Synthetic polypeptide
VTTGLDRESFPTYTLVVQAADLQGEGLSTTATAVITVTDT

SEQ ID NO: 5284 - protein, 40 aa, Artificial Sequence
  Description of Artificial Sequence: Synthetic polypeptide
TTGLDRESFPTYTLVVQAADLQGEGLSTTATAVITVTDTN

SEQ ID NO: 5285 - protein, 40 aa, Artificial Sequence
  Description of Artificial Sequence: Synthetic polypeptide
MDRESFPTYTLVVQAADLQGEGLSTTATAVITVTDTNDNP

SEQ ID NO: 5286 - protein, 40 aa, Artificial Sequence
  Description of Artificial Sequence: Synthetic polypeptide
EANVVITTLKVTDADAPNTPAWEAVYTILNDDGGQFVVTT

SEQ ID NO: 5287 - protein, 40 aa, Artificial Sequence
  Description of Artificial Sequence: Synthetic polypeptide
AVYTILNDDGGQFVVTTNPVNNDGILKTAKGLDFEAKQQY

SEQ ID NO: 5288 - protein, 40 aa, Artificial Sequence
  Description of Artificial Sequence: Synthetic polypeptide
VYTILNDDGGQFVVTTNPVNNDGILKTAKGLDFEAKQQYI

SEQ ID NO: 5289 - protein, 40 aa, Artificial Sequence
  Description of Artificial Sequence: Synthetic polypeptide
YTILNDDGGQFVVTTNPVNNDGILKTAKGLDFEAKQQYIL

SEQ ID NO: 5290 - protein, 40 aa, Artificial Sequence
  Description of Artificial Sequence: Synthetic polypeptide
PFTAELTHGASANWTIQYNDPTQESIILKPKMALEVGDYK

SEQ ID NO: 5291 - protein, 40 aa, Artificial Sequence
  Description of Artificial Sequence: Synthetic polypeptide
LTHGASANWTIQYNDPTQESIILKPKMALEVGDYKINLKL

SEQ ID NO: 5292 - protein, 40 aa, Artificial Sequence
  Description of Artificial Sequence: Synthetic polypeptide
GASANWTIQYNDPTQESIILKPKMALEVGDYKINLKLMDN

SEQ ID NO: 5293 - protein, 40 aa, Artificial Sequence
  Description of Artificial Sequence: Synthetic polypeptide
SANWTIQYNDPTQESIILKPKMALEVGDYKINLKLMDNQN

SEQ ID NO: 5294 - protein, 40 aa, Artificial Sequence
  Description of Artificial Sequence: Synthetic polypeptide
WTIQYNDPTQESIILKPKMALEVGDYKINLKLMDNQNKDQ

SEQ ID NO: 5295 - protein, 40 aa, Artificial Sequence
  Description of Artificial Sequence: Synthetic polypeptide
TIQYNDPTQESIILKPKMALEVGDYKINLKLMDNQNKDQV

SEQ ID NO: 5296 - protein, 40 aa, Artificial Sequence
  Description of Artificial Sequence: Synthetic polypeptide
QYNDPTQESIILKPKMALEVGDYKINLKLMDNQNKDQVTT

SEQ ID NO: 5297 - protein, 40 aa, Artificial Sequence
  Description of Artificial Sequence: Synthetic polypeptide
NDPTQESIILKPKMALEVGDYKINLKLMDNQNKDQVTTLE

SEQ ID NO: 5298 - protein, 40 aa, Artificial Sequence
  Description of Artificial Sequence: Synthetic polypeptide
DPTQESIILKPKMALEVGDYKINLKLMDNQNKDQVTTLEV

SEQ ID NO: 5299 - protein, 40 aa, Artificial Sequence
  Description of Artificial Sequence: Synthetic polypeptide
TQESIILKPKMALEVGDYKINLKLMDNQNKDQVTTLEVSV

SEQ ID NO: 5300 - protein, 40 aa, Artificial Sequence
  Description of Artificial Sequence: Synthetic polypeptide
SIILKPKMALEVGDYKINLKLMDNQNKDQVTTLEVSVCDC

SEQ ID NO: 5301 - protein, 40 aa, Artificial Sequence
  Description of Artificial Sequence: Synthetic polypeptide
MALEVGDYKINLKLMDNQNKDQVTTLEVSVCDCEGAAGVC

SEQ ID NO: 5302 - protein, 40 aa, Artificial Sequence
  Description of Artificial Sequence: Synthetic polypeptide
ALEVGDYKINLKLMDNQNKDQVTTLEVSVCDCEGAAGVCR

SEQ ID NO: 5303 - protein, 40 aa, Artificial Sequence
  Description of Artificial Sequence: Synthetic polypeptide
NQNKDQVTTLEVSVCDCEGAAGVCRKAQPVEAGLQIPAIL

SEQ ID NO: 5304 - protein, 40 aa, Artificial Sequence
  Description of Artificial Sequence: Synthetic polypeptide
AAGVCRKAQPVEAGLQIPAILGILGGILALLILILLLLLF

SEQ ID NO: 5305 - protein, 40 aa, Artificial Sequence
  Description of Artificial Sequence: Synthetic polypeptide
QIPAILGILGGILALLILILLLLLFLRRRAVVKEPLLPPE

SEQ ID NO: 5306 - protein, 40 aa, Artificial Sequence
  Description of Artificial Sequence: Synthetic polypeptide
MHRGLDARPEVTRNDVAPTLMSVPRYLPRPANPDEIGNFI

SEQ ID NO: 5307 - protein, 40 aa, Artificial Sequence
  Description of Artificial Sequence: Synthetic polypeptide
NPDEIGNFIDENLKAADTDPTAPPYDSLLVFDYEGSGSEA

SEQ ID NO: 5308 - protein, 40 aa, Artificial Sequence
  Description of Artificial Sequence: Synthetic polypeptide
DEIGNFIDENLKAADTDPTAPPYDSLLVFDYEGSGSEAAS

SEQ ID NO: 5309 - protein, 40 aa, Artificial Sequence
  Description of Artificial Sequence: Synthetic polypeptide
EIGNFIDENLKAADTDPTAPPYDSLLVFDYEGSGSEAASL

SEQ ID NO: 5310 - protein, 40 aa, Artificial Sequence
  Description of Artificial Sequence: Synthetic polypeptide
IGNFIDENLKAADTDPTAPPYDSLLVFDYEGSGSEAASLS

SEQ ID NO: 5311 - protein, 40 aa, Artificial Sequence
  Description of Artificial Sequence: Synthetic polypeptide
SHSSSGTLSSLETVSTQELYSIPEDQEPEDQEPEEPTPAP

SEQ ID NO: 5312 - protein, 40 aa, Artificial Sequence
  Description of Artificial Sequence: Synthetic polypeptide
HSSSGTLSSLETVSTQELYSIPEDQEPEDQEPEEPTPAPW

SEQ ID NO: 5313 - protein, 40 aa, Artificial Sequence
  Description of Artificial Sequence: Synthetic polypeptide
SSSGTLSSLETVSTQELYSIPEDQEPEDQEPEEPTPAPWA

SEQ ID NO: 5314 - protein, 40 aa, Artificial Sequence
  Description of Artificial Sequence: Synthetic polypeptide
SSGTLSSLETVSTQELYSIPEDQEPEDQEPEEPTPAPWAR

SEQ ID NO: 5315 - protein, 40 aa, Artificial Sequence
  Description of Artificial Sequence: Synthetic polypeptide
SGTLSSLETVSTQELYSIPEDQEPEDQEPEEPTPAPWARL

SEQ ID NO: 5316 - protein, 40 aa, Artificial Sequence
  Description of Artificial Sequence: Synthetic polypeptide
TLSSLETVSTQELYSIPEDQEPEDQEPEEPTPAPWARLWA

SEQ ID NO: 5317 - protein, 40 aa, Artificial Sequence
  Description of Artificial Sequence: Synthetic polypeptide
MSSLETVSTQELYSIPEDQEPEDQEPEEPTPAPWARLWAL

SEQ ID NO: 5318 - protein, 40 aa, Artificial Sequence
  Description of Artificial Sequence: Synthetic polypeptide
SLETVSTQELYSIPEDQEPEDQEPEEPTPAPWARLWALQD

SEQ ID NO: 5319 - protein, 40 aa, Artificial Sequence
  Description of Artificial Sequence: Synthetic polypeptide
LETVSTQELYSIPEDQEPEDQEPEEPTPAPWARLWALQDG

SEQ ID NO: 5320 - protein, 40 aa, Artificial Sequence
  Description of Artificial Sequence: Synthetic polypeptide
TVSTQELYSIPEDQEPEDQEPEEPTPAPWARLWALQDGFA

SEQ ID NO: 5321 - protein, 40 aa, Artificial Sequence
  Description of Artificial Sequence: Synthetic polypeptide
VSTQELYSIPEDQEPEDQEPEEPTPAPWARLWALQDGFAN

SEQ ID NO: 5322 - protein, 40 aa, Artificial Sequence
  Description of Artificial Sequence: Synthetic polypeptide
STQELYSIPEDQEPEDQEPEEPTPAPWARLWALQDGFANL

SEQ ID NO: 5323 - protein, 40 aa, Artificial Sequence
  Description of Artificial Sequence: Synthetic polypeptide
TQELYSIPEDQEPEDQEPEEPTPAPWARLWALQDGFANLE

SEQ ID NO: 5324 - protein, 40 aa, Artificial Sequence
  Description of Artificial Sequence: Synthetic polypeptide
QELYSIPEDQEPEDQEPEEPTPAPWARLWALQDGFANLEC

SEQ ID NO: 5325 - protein, 40 aa, Artificial Sequence
  Description of Artificial Sequence: Synthetic polypeptide
LYSIPEDQEPEDQEPEEPTPAPWARLWALQDGFANLECVN

SEQ ID NO: 5326 - protein, 40 aa, Artificial Sequence
  Description of Artificial Sequence: Synthetic polypeptide
QEPEDQEPEEPTPAPWARLWALQDGFANLECVNDNYWFGR

SEQ ID NO: 5327 - protein, 40 aa, Artificial Sequence
  Description of Artificial Sequence: Synthetic polypeptide
DQEPEEPTPAPWARLWALQDGFANLECVNDNYWFGRDKSC

SEQ ID NO: 5328 - protein, 40 aa, Artificial Sequence
  Description of Artificial Sequence: Synthetic polypeptide
TPAPWARLWALQDGFANLECVNDNYWFGRDKSCEYCFDEP

SEQ ID NO: 5329 - protein, 40 aa, Artificial Sequence
  Description of Artificial Sequence: Synthetic polypeptide
APWARLWALQDGFANLECVNDNYWFGRDKSCEYCFDEPLL

SEQ ID NO: 5330 - protein, 40 aa, Artificial Sequence
  Description of Artificial Sequence: Synthetic polypeptide
PWARLWALQDGFANLECVNDNYWFGRDKSCEYCFDEPLLK

SEQ ID NO: 5331 - protein, 40 aa, Artificial Sequence
  Description of Artificial Sequence: Synthetic polypeptide
WARLWALQDGFANLECVNDNYWFGRDKSCEYCFDEPLLKR

SEQ ID NO: 5332 - protein, 40 aa, Artificial Sequence
  Description of Artificial Sequence: Synthetic polypeptide
QDGFANLECVNDNYWFGRDKSCEYCFDEPLLKRTDKYRTY

SEQ ID NO: 5333 - protein, 40 aa, Artificial Sequence
  Description of Artificial Sequence: Synthetic polypeptide
GFANLECVNDNYWFGRDKSCEYCFDEPLLKRTDKYRTYSK

SEQ ID NO: 5334 - protein, 40 aa, Artificial Sequence
  Description of Artificial Sequence: Synthetic polypeptide
NLECVNDNYWFGRDKSCEYCFDEPLLKRTDKYRTYSKKHF

SEQ ID NO: 5335 - protein, 40 aa, Artificial Sequence
  Description of Artificial Sequence: Synthetic polypeptide
VNDNYWFGRDKSCEYCFDEPLLKRTDKYRTYSKKHFRIFR

SEQ ID NO: 5336 - protein, 40 aa, Artificial Sequence
  Description of Artificial Sequence: Synthetic polypeptide
CEYCFDEPLLKRTDKYRTYSKKHFRIFREVGPKNSYIAYI

SEQ ID NO: 5337 - protein, 40 aa, Artificial Sequence
  Description of Artificial Sequence: Synthetic polypeptide
EYCFDEPLLKRTDKYRTYSKKHFRIFREVGPKNSYIAYIE

SEQ ID NO: 5338 - protein, 40 aa, Artificial Sequence
  Description of Artificial Sequence: Synthetic polypeptide
YCFDEPLLKRTDKYRTYSKKHFRIFREVGPKNSYIAYIED

SEQ ID NO: 5339 - protein, 40 aa, Artificial Sequence
  Description of Artificial Sequence: Synthetic polypeptide
CFDEPLLKRTDKYRTYSKKHFRIFREVGPKNSYIAYIEDH

SEQ ID NO: 5340 - protein, 40 aa, Artificial Sequence
  Description of Artificial Sequence: Synthetic polypeptide
PLLKRTDKYRTYSKKHFRIFREVGPKNSYIAYIEDHSGNG

SEQ ID NO: 5341 - protein, 40 aa, Artificial Sequence
  Description of Artificial Sequence: Synthetic polypeptide
MLKRTDKYRTYSKKHFRIFREVGPKNSYIAYIEDHSGNGT

SEQ ID NO: 5342 - protein, 40 aa, Artificial Sequence
  Description of Artificial Sequence: Synthetic polypeptide
SKKHFRIFREVGPKNSYIAYIEDHSGNGTFVNTELVGKGK

SEQ ID NO: 5343 - protein, 40 aa, Artificial Sequence
  Description of Artificial Sequence: Synthetic polypeptide
KHFRIFREVGPKNSYIAYIEDHSGNGTFVNTELVGKGKRR

SEQ ID NO: 5344 - protein, 40 aa, Artificial Sequence
  Description of Artificial Sequence: Synthetic polypeptide
HFRIFREVGPKNSYIAYIEDHSGNGTFVNTELVGKGKRRP

SEQ ID NO: 5345 - protein, 40 aa, Artificial Sequence
  Description of Artificial Sequence: Synthetic polypeptide
RIFREVGPKNSYIAYIEDHSGNGTFVNTELVGKGKRRPLN

SEQ ID NO: 5346 - protein, 40 aa, Artificial Sequence
  Description of Artificial Sequence: Synthetic polypeptide
IFREVGPKNSYIAYIEDHSGNGTFVNTELVGKGKRRPLNN

SEQ ID NO: 5347 - protein, 40 aa, Artificial Sequence
  Description of Artificial Sequence: Synthetic polypeptide
FREVGPKNSYIAYIEDHSGNGTFVNTELVGKGKRRPLNNN

SEQ ID NO: 5348 - protein, 40 aa, Artificial Sequence
  Description of Artificial Sequence: Synthetic polypeptide
EVGPKNSYIAYIEDHSGNGTFVNTELVGKGKRRPLNNNSE

SEQ ID NO: 5349 - protein, 40 aa, Artificial Sequence
  Description of Artificial Sequence: Synthetic polypeptide
VGPKNSYIAYIEDHSGNGTFVNTELVGKGKRRPLNNNSEI

SEQ ID NO: 5350 - protein, 40 aa, Artificial Sequence
  Description of Artificial Sequence: Synthetic polypeptide
KNSYIAYIEDHSGNGTFVNTELVGKGKRRPLNNNSEIALS

SEQ ID NO: 5351 - protein, 40 aa, Artificial Sequence
  Description of Artificial Sequence: Synthetic polypeptide
NSYIAYIEDHSGNGTFVNTELVGKGKRRPLNNNSEIALSL

SEQ ID NO: 5352 - protein, 40 aa, Artificial Sequence
  Description of Artificial Sequence: Synthetic polypeptide
SYIAYIEDHSGNGTFVNTELVGKGKRRPLNNNSEIALSLS

SEQ ID NO: 5353 - protein, 40 aa, Artificial Sequence
  Description of Artificial Sequence: Synthetic polypeptide
IAYIEDHSGNGTFVNTELVGKGKRRPLNNNSEIALSLSRN

SEQ ID NO: 5354 - protein, 40 aa, Artificial Sequence
  Description of Artificial Sequence: Synthetic polypeptide
YIEDHSGNGTFVNTELVGKGKRRPLNNNSEIALSLSRNKV

SEQ ID NO: 5355 - protein, 40 aa, Artificial Sequence
  Description of Artificial Sequence: Synthetic polypeptide
IEDHSGNGTFVNTELVGKGKRRPLNNNSEIALSLSRNKVF

SEQ ID NO: 5356 - protein, 40 aa, Artificial Sequence
  Description of Artificial Sequence: Synthetic polypeptide
NTELVGKGKRRPLNNNSEIALSLSRNKVFVFFDLTVDDQS

SEQ ID NO: 5357 - protein, 40 aa, Artificial Sequence
  Description of Artificial Sequence: Synthetic polypeptide
TELVGKGKRRPLNNNSEIALSLSRNKVFVFFDLTVDDQSV

SEQ ID NO: 5358 - protein, 40 aa, Artificial Sequence
  Description of Artificial Sequence: Synthetic polypeptide
ELVGKGKRRPLNNNSEIALSLSRNKVFVFFDLTVDDQSVY

SEQ ID NO: 5359 - protein, 40 aa, Artificial Sequence
  Description of Artificial Sequence: Synthetic polypeptide
LVGKGKRRPLNNNSEIALSLSRNKVFVFFDLTVDDQSVYP

SEQ ID NO: 5360 - protein, 40 aa, Artificial Sequence
  Description of Artificial Sequence: Synthetic polypeptide
VGKGKRRPLNNNSEIALSLSRNKVFVFFDLTVDDQSVYPK

SEQ ID NO: 5361 - protein, 40 aa, Artificial Sequence
  Description of Artificial Sequence: Synthetic polypeptide
GKRRPLNNNSEIALSLSRNKVFVFFDLTVDDQSVYPKALR

SEQ ID NO: 5362 - protein, 40 aa, Artificial Sequence
  Description of Artificial Sequence: Synthetic polypeptide
KRRPLNNNSEIALSLSRNKVFVFFDLTVDDQSVYPKALRD

SEQ ID NO: 5363 - protein, 40 aa, Artificial Sequence
  Description of Artificial Sequence: Synthetic polypeptide
NNSEIALSLSRNKVFVFFDLTVDDQSVYPKALRDEYIMSK

SEQ ID NO: 5364 - protein, 40 aa, Artificial Sequence
  Description of Artificial Sequence: Synthetic polypeptide
IALSLSRNKVFVFFDLTVDDQSVYPKALRDEYIMSKTLGS

SEQ ID NO: 5365 - protein, 40 aa, Artificial Sequence
  Description of Artificial Sequence: Synthetic polypeptide
RNKVFVFFDLTVDDQSVYPKALRDEYIMSKTLGSGACGEV

SEQ ID NO: 5366 - protein, 40 aa, Artificial Sequence
  Description of Artificial Sequence: Synthetic polypeptide
NKVFVFFDLTVDDQSVYPKALRDEYIMSKTLGSGACGEVK

SEQ ID NO: 5367 - protein, 40 aa, Artificial Sequence
  Description of Artificial Sequence: Synthetic polypeptide
VFVFFDLTVDDQSVYPKALRDEYIMSKTLGSGACGEVKLA

SEQ ID NO: 5368 - protein, 40 aa, Artificial Sequence
  Description of Artificial Sequence: Synthetic polypeptide
FVFFDLTVDDQSVYPKALRDEYIMSKTLGSGACGEVKLAF

SEQ ID NO: 5369 - protein, 40 aa, Artificial Sequence
  Description of Artificial Sequence: Synthetic polypeptide
VFFDLTVDDQSVYPKALRDEYIMSKTLGSGACGEVKLAFE

SEQ ID NO: 5370 - protein, 40 aa, Artificial Sequence
  Description of Artificial Sequence: Synthetic polypeptide
TVDDQSVYPKALRDEYIMSKTLGSGACGEVKLAFERKTCK

SEQ ID NO: 5371 - protein, 40 aa, Artificial Sequence
  Description of Artificial Sequence: Synthetic polypeptide
YPKALRDEYIMSKTLGSGACGEVKLAFERKTCKKVAIKII

SEQ ID NO: 5372 - protein, 40 aa, Artificial Sequence
  Description of Artificial Sequence: Synthetic polypeptide
ALRDEYIMSKTLGSGACGEVKLAFERKTCKKVAIKIISKR

SEQ ID NO: 5373 - protein, 40 aa, Artificial Sequence
  Description of Artificial Sequence: Synthetic polypeptide
FERKTCKKVAIKIISKRKFAIGSAREADPALNVETEIEIL

SEQ ID NO: 5374 - protein, 40 aa, Artificial Sequence
  Description of Artificial Sequence: Synthetic polypeptide
KKVAIKIISKRKFAIGSAREADPALNVETEIEILKKLNHP

SEQ ID NO: 5375 - protein, 40 aa, Artificial Sequence
  Description of Artificial Sequence: Synthetic polypeptide
KVAIKIISKRKFAIGSAREADPALNVETEIEILKKLNHPC

SEQ ID NO: 5376 - protein, 40 aa, Artificial Sequence
  Description of Artificial Sequence: Synthetic polypeptide
KRKFAIGSAREADPALNVETEIEILKKLNHPCIIKIKNFF

SEQ ID NO: 5377 - protein, 40 aa, Artificial Sequence
  Description of Artificial Sequence: Synthetic polypeptide
RKFAIGSAREADPALNVETEIEILKKLNHPCIIKIKNFFD

SEQ ID NO: 5378 - protein, 40 aa, Artificial Sequence
  Description of Artificial Sequence: Synthetic polypeptide
KFAIGSAREADPALNVETEIEILKKLNHPCIIKIKNFFDA

SEQ ID NO: 5379 - protein, 40 aa, Artificial Sequence
  Description of Artificial Sequence: Synthetic polypeptide
FAIGSAREADPALNVETEIEILKKLNHPCIIKIKNFFDAE

SEQ ID NO: 5380 - protein, 40 aa, Artificial Sequence
  Description of Artificial Sequence: Synthetic polypeptide
AIGSAREADPALNVETEIEILKKLNHPCIIKIKNFFDAED

SEQ ID NO: 5381 - protein, 40 aa, Artificial Sequence
  Description of Artificial Sequence: Synthetic polypeptide
GSAREADPALNVETEIEILKKLNHPCIIKIKNFFDAEDYY

SEQ ID NO: 5382 - protein, 40 aa, Artificial Sequence
  Description of Artificial Sequence: Synthetic polypeptide
AREADPALNVETEIEILKKLNHPCIIKIKNFFDAEDYYIV

SEQ ID NO: 5383 - protein, 40 aa, Artificial Sequence
  Description of Artificial Sequence: Synthetic polypeptide
EADPALNVETEIEILKKLNHPCIIKIKNFFDAEDYYIVLE

SEQ ID NO: 5384 - protein, 40 aa, Artificial Sequence
  Description of Artificial Sequence: Synthetic polypeptide
PALNVETEIEILKKLNHPCIIKIKNFFDAEDYYIVLELME

SEQ ID NO: 5385 - protein, 40 aa, Artificial Sequence
  Description of Artificial Sequence: Synthetic polypeptide
LNVETEIEILKKLNHPCIIKIKNFFDAEDYYIVLELMEGG

SEQ ID NO: 5386 - protein, 40 aa, Artificial Sequence
  Description of Artificial Sequence: Synthetic polypeptide
NVETEIEILKKLNHPCIIKIKNFFDAEDYYIVLELMEGGE

SEQ ID NO: 5387 - protein, 40 aa, Artificial Sequence
  Description of Artificial Sequence: Synthetic polypeptide
VETEIEILKKLNHPCIIKIKNFFDAEDYYIVLELMEGGEL

SEQ ID NO: 5388 - protein, 40 aa, Artificial Sequence
  Description of Artificial Sequence: Synthetic polypeptide
TEIEILKKLNHPCIIKIKNFFDAEDYYIVLELMEGGELFD

SEQ ID NO: 5389 - protein, 40 aa, Artificial Sequence
  Description of Artificial Sequence: Synthetic polypeptide
EIEILKKLNHPCIIKIKNFFDAEDYYIVLELMEGGELFDK

SEQ ID NO: 5390 - protein, 40 aa, Artificial Sequence
  Description of Artificial Sequence: Synthetic polypeptide
IEILKKLNHPCIIKIKNFFDAEDYYIVLELMEGGELFDKV

SEQ ID NO: 5391 - protein, 40 aa, Artificial Sequence
  Description of Artificial Sequence: Synthetic polypeptide
KKLNHPCIIKIKNFFDAEDYYIVLELMEGGELFDKVVGNK

SEQ ID NO: 5392 - protein, 40 aa, Artificial Sequence
  Description of Artificial Sequence: Synthetic polypeptide
LNHPCIIKIKNFFDAEDYYIVLELMEGGELFDKVVGNKRL

SEQ ID NO: 5393 - protein, 40 aa, Artificial Sequence
  Description of Artificial Sequence: Synthetic polypeptide
NHPCIIKIKNFFDAEDYYIVLELMEGGELFDKVVGNKRLK

SEQ ID NO: 5394 - protein, 40 aa, Artificial Sequence
  Description of Artificial Sequence: Synthetic polypeptide
PCIIKIKNFFDAEDYYIVLELMEGGELFDKVVGNKRLKEA

SEQ ID NO: 5395 - protein, 40 aa, Artificial Sequence
  Description of Artificial Sequence: Synthetic polypeptide
CIIKIKNFFDAEDYYIVLELMEGGELFDKVVGNKRLKEAT

SEQ ID NO: 5396 - protein, 40 aa, Artificial Sequence
  Description of Artificial Sequence: Synthetic polypeptide
IIKIKNFFDAEDYYIVLELMEGGELFDKVVGNKRLKEATC

SEQ ID NO: 5397 - protein, 40 aa, Artificial Sequence
  Description of Artificial Sequence: Synthetic polypeptide
KIKNFFDAEDYYIVLELMEGGELFDKVVGNKRLKEATCKL

SEQ ID NO: 5398 - protein, 40 aa, Artificial Sequence
  Description of Artificial Sequence: Synthetic polypeptide
IKNFFDAEDYYIVLELMEGGELFDKVVGNKRLKEATCKLY

SEQ ID NO: 5399 - protein, 40 aa, Artificial Sequence
  Description of Artificial Sequence: Synthetic polypeptide
NFFDAEDYYIVLELMEGGELFDKVVGNKRLKEATCKLYFY

SEQ ID NO: 5400 - protein, 40 aa, Artificial Sequence
  Description of Artificial Sequence: Synthetic polypeptide
DAEDYYIVLELMEGGELFDKVVGNKRLKEATCKLYFYQML

SEQ ID NO: 5401 - protein, 40 aa, Artificial Sequence
  Description of Artificial Sequence: Synthetic polypeptide
AEDYYIVLELMEGGELFDKVVGNKRLKEATCKLYFYQMLL

SEQ ID NO: 5402 - protein, 40 aa, Artificial Sequence
  Description of Artificial Sequence: Synthetic polypeptide
DYYIVLELMEGGELFDKVVGNKRLKEATCKLYFYQMLLAV

SEQ ID NO: 5403 - protein, 40 aa, Artificial Sequence
  Description of Artificial Sequence: Synthetic polypeptide
YIVLELMEGGELFDKVVGNKRLKEATCKLYFYQMLLAVQY

SEQ ID NO: 5404 - protein, 40 aa, Artificial Sequence
  Description of Artificial Sequence: Synthetic polypeptide
IVLELMEGGELFDKVVGNKRLKEATCKLYFYQMLLAVQYL

SEQ ID NO: 5405 - protein, 40 aa, Artificial Sequence
  Description of Artificial Sequence: Synthetic polypeptide
EGGELFDKVVGNKRLKEATCKLYFYQMLLAVQYLHENGII

SEQ ID NO: 5406 - protein, 40 aa, Artificial Sequence
  Description of Artificial Sequence: Synthetic polypeptide
GGELFDKVVGNKRLKEATCKLYFYQMLLAVQYLHENGIIH

SEQ ID NO: 5407 - protein, 40 aa, Artificial Sequence
  Description of Artificial Sequence: Synthetic polypeptide
GELFDKVVGNKRLKEATCKLYFYQMLLAVQYLHENGIIHR

SEQ ID NO: 5408 - protein, 40 aa, Artificial Sequence
  Description of Artificial Sequence: Synthetic polypeptide
FDKVVGNKRLKEATCKLYFYQMLLAVQYLHENGIIHRDLK

SEQ ID NO: 5409 - protein, 40 aa, Artificial Sequence
  Description of Artificial Sequence: Synthetic polypeptide
MKEATCKLYFYQMLLAVQYLHENGIIHRDLKPENVLLSSQ

SEQ ID NO: 5410 - protein, 40 aa, Artificial Sequence
  Description of Artificial Sequence: Synthetic polypeptide
SQEEDCLIKITDFGHSKILGETSLMRTLCGTPTYLAPEVL

SEQ ID NO: 5411 - protein, 40 aa, Artificial Sequence
  Description of Artificial Sequence: Synthetic polypeptide
QEEDCLIKITDFGHSKILGETSLMRTLCGTPTYLAPEVLV

SEQ ID NO: 5412 - protein, 40 aa, Artificial Sequence
  Description of Artificial Sequence: Synthetic polypeptide
EEDCLIKITDFGHSKILGETSLMRTLCGTPTYLAPEVLVS

SEQ ID NO: 5413 - protein, 40 aa, Artificial Sequence
  Description of Artificial Sequence: Synthetic polypeptide
EDCLIKITDFGHSKILGETSLMRTLCGTPTYLAPEVLVSV

SEQ ID NO: 5414 - protein, 40 aa, Artificial Sequence
  Description of Artificial Sequence: Synthetic polypeptide
DCLIKITDFGHSKILGETSLMRTLCGTPTYLAPEVLVSVG

SEQ ID NO: 5415 - protein, 40 aa, Artificial Sequence
  Description of Artificial Sequence: Synthetic polypeptide
CLIKITDFGHSKILGETSLMRTLCGTPTYLAPEVLVSVGT

SEQ ID NO: 5416 - protein, 40 aa, Artificial Sequence
  Description of Artificial Sequence: Synthetic polypeptide
LIKITDFGHSKILGETSLMRTLCGTPTYLAPEVLVSVGTA

SEQ ID NO: 5417 - protein, 40 aa, Artificial Sequence
  Description of Artificial Sequence: Synthetic polypeptide
KITDFGHSKILGETSLMRTLCGTPTYLAPEVLVSVGTAGY

SEQ ID NO: 5418 - protein, 40 aa, Artificial Sequence
  Description of Artificial Sequence: Synthetic polypeptide
ILGETSLMRTLCGTPTYLAPEVLVSVGTAGYNRAVDCWSL

SEQ ID NO: 5419 - protein, 40 aa, Artificial Sequence
  Description of Artificial Sequence: Synthetic polypeptide
ETSLMRTLCGTPTYLAPEVLVSVGTAGYNRAVDCWSLGVI

SEQ ID NO: 5420 - protein, 40 aa, Artificial Sequence
  Description of Artificial Sequence: Synthetic polypeptide
MRTLCGTPTYLAPEVLVSVGTAGYNRAVDCWSLGVILFIC

SEQ ID NO: 5421 - protein, 40 aa, Artificial Sequence
  Description of Artificial Sequence: Synthetic polypeptide
GTPTYLAPEVLVSVGTAGYNRAVDCWSLGVILFICLSGYP

SEQ ID NO: 5422 - protein, 40 aa, Artificial Sequence
  Description of Artificial Sequence: Synthetic polypeptide
APEVLVSVGTAGYNRAVDCWSLGVILFICLSGYPPFSEHR

SEQ ID NO: 5423 - protein, 40 aa, Artificial Sequence
  Description of Artificial Sequence: Synthetic polypeptide
EVLVSVGTAGYNRAVDCWSLGVILFICLSGYPPFSEHRTQ

SEQ ID NO: 5424 - protein, 40 aa, Artificial Sequence
  Description of Artificial Sequence: Synthetic polypeptide
VLVSVGTAGYNRAVDCWSLGVILFICLSGYPPFSEHRTQV

SEQ ID NO: 5425 - protein, 40 aa, Artificial Sequence
  Description of Artificial Sequence: Synthetic polypeptide
VSVGTAGYNRAVDCWSLGVILFICLSGYPPFSEHRTQVSL

SEQ ID NO: 5426 - protein, 40 aa, Artificial Sequence
  Description of Artificial Sequence: Synthetic polypeptide
GYNRAVDCWSLGVILFICLSGYPPFSEHRTQVSLKDQITS

SEQ ID NO: 5427 - protein, 40 aa, Artificial Sequence
  Description of Artificial Sequence: Synthetic polypeptide
YNRAVDCWSLGVILFICLSGYPPFSEHRTQVSLKDQITSG

SEQ ID NO: 5428 - protein, 40 aa, Artificial Sequence
  Description of Artificial Sequence: Synthetic polypeptide
DCWSLGVILFICLSGYPPFSEHRTQVSLKDQITSGKYNFI

SEQ ID NO: 5429 - protein, 40 aa, Artificial Sequence
  Description of Artificial Sequence: Synthetic polypeptide
CWSLGVILFICLSGYPPFSEHRTQVSLKDQITSGKYNFIP

SEQ ID NO: 5430 - protein, 40 aa, Artificial Sequence
  Description of Artificial Sequence: Synthetic polypeptide
WSLGVILFICLSGYPPFSEHRTQVSLKDQITSGKYNFIPE

SEQ ID NO: 5431 - protein, 40 aa, Artificial Sequence
  Description of Artificial Sequence: Synthetic polypeptide
LGVILFICLSGYPPFSEHRTQVSLKDQITSGKYNFIPEVW

SEQ ID NO: 5432 - protein, 40 aa, Artificial Sequence
  Description of Artificial Sequence: Synthetic polypeptide
VILFICLSGYPPFSEHRTQVSLKDQITSGKYNFIPEVWAE

SEQ ID NO: 5433 - protein, 40 aa, Artificial Sequence
  Description of Artificial Sequence: Synthetic polypeptide
VSLKDQITSGKYNFIPEVWAEVSEKALDLVKKLLVVDPKA

SEQ ID NO: 5434 - protein, 40 aa, Artificial Sequence
  Description of Artificial Sequence: Synthetic polypeptide
TSGKYNFIPEVWAEVSEKALDLVKKLLVVDPKARFTTEEA

SEQ ID NO: 5435 - protein, 40 aa, Artificial Sequence
  Description of Artificial Sequence: Synthetic polypeptide
SGKYNFIPEVWAEVSEKALDLVKKLLVVDPKARFTTEEAL

SEQ ID NO: 5436 - protein, 40 aa, Artificial Sequence
  Description of Artificial Sequence: Synthetic polypeptide
PEVWAEVSEKALDLVKKLLVVDPKARFTTEEALRHPWLQD

SEQ ID NO: 5437 - protein, 40 aa, Artificial Sequence
  Description of Artificial Sequence: Synthetic polypeptide
VWAEVSEKALDLVKKLLVVDPKARFTTEEALRHPWLQDED

SEQ ID NO: 5438 - protein, 40 aa, Artificial Sequence
  Description of Artificial Sequence: Synthetic polypeptide
AEVSEKALDLVKKLLVVDPKARFTTEEALRHPWLQDEDMK

SEQ ID NO: 5439 - protein, 40 aa, Artificial Sequence
  Description of Artificial Sequence: Synthetic polypeptide
EVSEKALDLVKKLLVVDPKARFTTEEALRHPWLQDEDMKR

SEQ ID NO: 5440 - protein, 40 aa, Artificial Sequence
  Description of Artificial Sequence: Synthetic polypeptide
SEKALDLVKKLLVVDPKARFTTEEALRHPWLQDEDMKRKF

SEQ ID NO: 5441 - protein, 40 aa, Artificial Sequence
  Description of Artificial Sequence: Synthetic polypeptide
EKALDLVKKLLVVDPKARFTTEEALRHPWLQDEDMKRKFQ

SEQ ID NO: 5442 - protein, 40 aa, Artificial Sequence
  Description of Artificial Sequence: Synthetic polypeptide
KALDLVKKLLVVDPKARFTTEEALRHPWLQDEDMKRKFQD

SEQ ID NO: 5443 - protein, 40 aa, Artificial Sequence
  Description of Artificial Sequence: Synthetic polypeptide
DLVKKLLVVDPKARFTTEEALRHPWLQDEDMKRKFQDLLS

SEQ ID NO: 5444 - protein, 40 aa, Artificial Sequence
  Description of Artificial Sequence: Synthetic polypeptide
FTTEEALRHPWLQDEDMKRKFQDLLSEENESTALPQVLAQ

SEQ ID NO: 5445 - protein, 40 aa, Artificial Sequence
  Description of Artificial Sequence: Synthetic polypeptide
EEALRHPWLQDEDMKRKFQDLLSEENESTALPQVLAQPST

SEQ ID NO: 5446 - protein, 40 aa, Artificial Sequence
  Description of Artificial Sequence: Synthetic polypeptide
KRKFQDLLSEENESTALPQVLAQPSTSRKRPREGEAEGAE

SEQ ID NO: 5447 - protein, 40 aa, Artificial Sequence
  Description of Artificial Sequence: Synthetic polypeptide
KFQDLLSEENESTALPQVLAQPSTSRKRPREGEAEGAETT

SEQ ID NO: 5448 - protein, 40 aa, Artificial Sequence
  Description of Artificial Sequence: Synthetic polypeptide
SEENESTALPQVLAQPSTSRKRPREGEAEGAETTKRPAVC

SEQ ID NO: 5449 - protein, 40 aa, Artificial Sequence
  Description of Artificial Sequence: Synthetic polypeptide
EENESTALPQVLAQPSTSRKRPREGEAEGAETTKRPAVCA

SEQ ID NO: 5450 - protein, 40 aa, Artificial Sequence
  Description of Artificial Sequence: Synthetic polypeptide
ENESTALPQVLAQPSTSRKRPREGEAEGAETTKRPAVCAA

SEQ ID NO: 5451 - protein, 40 aa, Artificial Sequence
  Description of Artificial Sequence: Synthetic polypeptide
YQDDAELATRAIPELTKLLNDEDQVVVNKAAVMVHQLSKK

SEQ ID NO: 5452 - protein, 40 aa, Artificial Sequence
  Description of Artificial Sequence: Synthetic polypeptide
LATRAIPELTKLLNDEDQVVVNKAAVMVHQLSKKEASRHA

SEQ ID NO: 5453 - protein, 40 aa, Artificial Sequence
  Description of Artificial Sequence: Synthetic polypeptide
ATRAIPELTKLLNDEDQVVVNKAAVMVHQLSKKEASRHAI

SEQ ID NO: 5454 - protein, 40 aa, Artificial Sequence
  Description of Artificial Sequence: Synthetic polypeptide
VLFYAITTLHNLLLHQEGAKMAVRLAGGLQKMVALLNKTN

SEQ ID NO: 5455 - protein, 40 aa, Artificial Sequence
  Description of Artificial Sequence: Synthetic polypeptide
AITTLHNLLLHQEGAKMAVRLAGGLQKMVALLNKTNVKFL

SEQ ID NO: 5456 - protein, 40 aa, Artificial Sequence
  Description of Artificial Sequence: Synthetic polypeptide
TLHNLLLHQEGAKMAVRLAGGLQKMVALLNKTNVKFLAIT

SEQ ID NO: 5457 - protein, 40 aa, Artificial Sequence
  Description of Artificial Sequence: Synthetic polypeptide
LHNLLLHQEGAKMAVRLAGGLQKMVALLNKTNVKFLAITT

SEQ ID NO: 5458 - protein, 40 aa, Artificial Sequence
  Description of Artificial Sequence: Synthetic polypeptide
LAGGLQKMVALLNKTNVKFLAITTDCLQILAYGNQESKLI

SEQ ID NO: 5459 - protein, 40 aa, Artificial Sequence
  Description of Artificial Sequence: Synthetic polypeptide
GGLQKMVALLNKTNVKFLAITTDCLQILAYGNQESKLIIL

SEQ ID NO: 5460 - protein, 40 aa, Artificial Sequence
  Description of Artificial Sequence: Synthetic polypeptide
KTNVKFLAITTDCLQILAYGNQESKLIILASGGPQALVNI

SEQ ID NO: 5461 - protein, 40 aa, Artificial Sequence
  Description of Artificial Sequence: Synthetic polypeptide
NVKFLAITTDCLQILAYGNQESKLIILASGGPQALVNIMR

SEQ ID NO: 5462 - protein, 40 aa, Artificial Sequence
  Description of Artificial Sequence: Synthetic polypeptide
FLAITTDCLQILAYGNQESKLIILASGGPQALVNIMRTYT

SEQ ID NO: 5463 - protein, 40 aa, Artificial Sequence
  Description of Artificial Sequence: Synthetic polypeptide
QILAYGNQESKLIILASGGPQALVNIMRTYTYEKLLWTTS

SEQ ID NO: 5464 - protein, 40 aa, Artificial Sequence
  Description of Artificial Sequence: Synthetic polypeptide
LAYGNQESKLIILASGGPQALVNIMRTYTYEKLLWTTSRV

SEQ ID NO: 5465 - protein, 40 aa, Artificial Sequence
  Description of Artificial Sequence: Synthetic polypeptide
SKLIILASGGPQALVNIMRTYTYEKLLWTTSRVLKVLSVC

SEQ ID NO: 5466 - protein, 40 aa, Artificial Sequence
  Description of Artificial Sequence: Synthetic polypeptide
IILASGGPQALVNIMRTYTYEKLLWTTSRVLKVLSVCSSN

SEQ ID NO: 5467 - protein, 40 aa, Artificial Sequence
  Description of Artificial Sequence: Synthetic polypeptide
ILASGGPQALVNIMRTYTYEKLLWTTSRVLKVLSVCSSNK

SEQ ID NO: 5468 - protein, 40 aa, Artificial Sequence
  Description of Artificial Sequence: Synthetic polypeptide
SGGPQALVNIMRTYTYEKLLWTTSRVLKVLSVCSSNKPAI

SEQ ID NO: 5469 - protein, 40 aa, Artificial Sequence
  Description of Artificial Sequence: Synthetic polypeptide
GGPQALVNIMRTYTYEKLLWTTSRVLKVLSVCSSNKPAIV

SEQ ID NO: 5470 - protein, 40 aa, Artificial Sequence
  Description of Artificial Sequence: Synthetic polypeptide
PQALVNIMRTYTYEKLLWTTSRVLKVLSVCSSNKPAIVEA

SEQ ID NO: 5471 - protein, 40 aa, Artificial Sequence
  Description of Artificial Sequence: Synthetic polypeptide
VNIMRTYTYEKLLWTTSRVLKVLSVCSSNKPAIVEAGGMQ

SEQ ID NO: 5472 - protein, 40 aa, Artificial Sequence
  Description of Artificial Sequence: Synthetic polypeptide
LSVCSSNKPAIVEAGGMQALGLHLTDPSQRLVQNCLWTLR

SEQ ID NO: 5473 - protein, 40 aa, Artificial Sequence
  Description of Artificial Sequence: Synthetic polypeptide
CSSNKPAIVEAGGMQALGLHLTDPSQRLVQNCLWTLRNLS

SEQ ID NO: 5474 - protein, 40 aa, Artificial Sequence
  Description of Artificial Sequence: Synthetic polypeptide
KQEGMEGLLGTLVQLLGSDDINVVTCAAGILSNLTCNNYK

SEQ ID NO: 5475 - protein, 40 aa, Artificial Sequence
  Description of Artificial Sequence: Synthetic polypeptide
QEGMEGLLGTLVQLLGSDDINVVTCAAGILSNLTCNNYKN

SEQ ID NO: 5476 - protein, 40 aa, Artificial Sequence
  Description of Artificial Sequence: Synthetic polypeptide
EGMEGLLGTLVQLLGSDDINVVTCAAGILSNLTCNNYKNK

SEQ ID NO: 5477 - protein, 40 aa, Artificial Sequence
  Description of Artificial Sequence: Synthetic polypeptide
GMEGLLGTLVQLLGSDDINVVTCAAGILSNLTCNNYKNKM

SEQ ID NO: 5478 - protein, 40 aa, Artificial Sequence
  Description of Artificial Sequence: Synthetic polypeptide
MEGLLGTLVQLLGSDDINVVTCAAGILSNLTCNNYKNKMM

SEQ ID NO: 5479 - protein, 40 aa, Artificial Sequence
  Description of Artificial Sequence: Synthetic polypeptide
GLLGTLVQLLGSDDINVVTCAAGILSNLTCNNYKNKMMVC

SEQ ID NO: 5480 - protein, 40 aa, Artificial Sequence
  Description of Artificial Sequence: Synthetic polypeptide
LLGSDDINVVTCAAGILSNLTCNNYKNKMMVCQVGGIEAL

SEQ ID NO: 5481 - protein, 40 aa, Artificial Sequence
  Description of Artificial Sequence: Synthetic polypeptide
DINVVTCAAGILSNLTCNNYKNKMMVCQVGGIEALVRTVL

SEQ ID NO: 5482 - protein, 40 aa, Artificial Sequence
  Description of Artificial Sequence: Synthetic polypeptide
TCAAGILSNLTCNNYKNKMMVCQVGGIEALVRTVLRAGDR

SEQ ID NO: 5483 - protein, 40 aa, Artificial Sequence
  Description of Artificial Sequence: Synthetic polypeptide
CQVGGIEALVRTVLRAGDREDITEPAICALRHLTSRHQEA

SEQ ID NO: 5484 - protein, 40 aa, Artificial Sequence
  Description of Artificial Sequence: Synthetic polypeptide
CALRHLTSRHQEAEMAQNAVRLHYGLPVVVKLLHPPSHWP

SEQ ID NO: 5485 - protein, 40 aa, Artificial Sequence
  Description of Artificial Sequence: Synthetic polypeptide
ANHAPLREQGAIPRLVQLLVRAHQDTQRRTSMGGTQQQFV

SEQ ID NO: 5486 - protein, 40 aa, Artificial Sequence
  Description of Artificial Sequence: Synthetic polypeptide
REQGAIPRLVQLLVRAHQDTQRRTSMGGTQQQFVEGVRME

SEQ ID NO: 5487 - protein, 40 aa, Artificial Sequence
  Description of Artificial Sequence: Synthetic polypeptide
GAIPRLVQLLVRAHQDTQRRTSMGGTQQQFVEGVRMEEIV

SEQ ID NO: 5488 - protein, 40 aa, Artificial Sequence
  Description of Artificial Sequence: Synthetic polypeptide
PRLVQLLVRAHQDTQRRTSMGGTQQQFVEGVRMEEIVEGC

SEQ ID NO: 5489 - protein, 40 aa, Artificial Sequence
  Description of Artificial Sequence: Synthetic polypeptide
MLVRAHQDTQRRTSMGGTQQQFVEGVRMEEIVEGCTGALH

SEQ ID NO: 5490 - protein, 40 aa, Artificial Sequence
  Description of Artificial Sequence: Synthetic polypeptide
LNTIPLFVQLLYSPIENIQRVAAGVLCELAQDKEAAEAIE

SEQ ID NO: 5491 - protein, 40 aa, Artificial Sequence
  Description of Artificial Sequence: Synthetic polypeptide
NTIPLFVQLLYSPIENIQRVAAGVLCELAQDKEAAEAIEA

SEQ ID NO: 5492 - protein, 40 aa, Artificial Sequence
  Description of Artificial Sequence: Synthetic polypeptide
QLLYSPIENIQRVAAGVLCELAQDKEAAEAIEAEGATAPL

SEQ ID NO: 5493 - protein, 40 aa, Artificial Sequence
  Description of Artificial Sequence: Synthetic polypeptide
MLYSPIENIQRVAAGVLCELAQDKEAAEAIEAEGATAPLT

SEQ ID NO: 5494 - protein, 40 aa, Artificial Sequence
  Description of Artificial Sequence: Synthetic polypeptide
YSPIENIQRVAAGVLCELAQDKEAAEAIEAEGATAPLTEL

SEQ ID NO: 5495 - protein, 40 aa, Artificial Sequence
  Description of Artificial Sequence: Synthetic polypeptide
SPIENIQRVAAGVLCELAQDKEAAEAIEAEGATAPLTELL

SEQ ID NO: 5496 - protein, 40 aa, Artificial Sequence
  Description of Artificial Sequence: Synthetic polypeptide
ENIQRVAAGVLCELAQDKEAAEAIEAEGATAPLTELLHSR

SEQ ID NO: 5497 - protein, 40 aa, Artificial Sequence
  Description of Artificial Sequence: Synthetic polypeptide
RVAAGVLCELAQDKEAAEAIEAEGATAPLTELLHSRNEGV

SEQ ID NO: 5498 - protein, 40 aa, Artificial Sequence
  Description of Artificial Sequence: Synthetic polypeptide
AQDKEAAEAIEAEGATAPLTELLHSRNEGVATYAAAVLFR

SEQ ID NO: 5499 - protein, 40 aa, Artificial Sequence
  Description of Artificial Sequence: Synthetic polypeptide
DKEAAEAIEAEGATAPLTELLHSRNEGVATYAAAVLFRMS

SEQ ID NO: 5500 - protein, 40 aa, Artificial Sequence
  Description of Artificial Sequence: Synthetic polypeptide
APLTELLHSRNEGVATYAAAVLFRMSEDKPQDYKKRLSVE

SEQ ID NO: 5501 - protein, 40 aa, Artificial Sequence
  Description of Artificial Sequence: Synthetic polypeptide
ELLHSRNEGVATYAAAVLFRMSEDKPQDYKKRLSVELTSS

SEQ ID NO: 5502 - protein, 40 aa, Artificial Sequence
  Description of Artificial Sequence: Synthetic polypeptide
ETADLGLDIGAQGEPLGYRQDDPSYRSFHSGGYGQDALGM

SEQ ID NO: 5503 - protein, 40 aa, Artificial Sequence
  Description of Artificial Sequence: Synthetic polypeptide
ALGLDQQFAGLDLNSSDNQSGGSTASKGRYIPPHLRNREA

SEQ ID NO: 5504 - protein, 40 aa, Artificial Sequence
  Description of Artificial Sequence: Synthetic polypeptide
QFAGLDLNSSDNQSGGSTASKGRYIPPHLRNREATKGFYD

SEQ ID NO: 5505 - protein, 40 aa, Artificial Sequence
  Description of Artificial Sequence: Synthetic polypeptide
GLDLNSSDNQSGGSTASKGRYIPPHLRNREATKGFYDKDS

SEQ ID NO: 5506 - protein, 40 aa, Artificial Sequence
  Description of Artificial Sequence: Synthetic polypeptide
NSSDNQSGGSTASKGRYIPPHLRNREATKGFYDKDSSGWS

SEQ ID NO: 5507 - protein, 40 aa, Artificial Sequence
  Description of Artificial Sequence: Synthetic polypeptide
ASKGRYIPPHLRNREATKGFYDKDSSGWSSSKDKDAYSSF

SEQ ID NO: 5508 - protein, 40 aa, Artificial Sequence
  Description of Artificial Sequence: Synthetic polypeptide
KGRYIPPHLRNREATKGFYDKDSSGWSSSKDKDAYSSFGS

SEQ ID NO: 5509 - protein, 40 aa, Artificial Sequence
  Description of Artificial Sequence: Synthetic polypeptide
GRYIPPHLRNREATKGFYDKDSSGWSSSKDKDAYSSFGSR

SEQ ID NO: 5510 - protein, 40 aa, Artificial Sequence
  Description of Artificial Sequence: Synthetic polypeptide
YIPPHLRNREATKGFYDKDSSGWSSSKDKDAYSSFGSRSD

SEQ ID NO: 5511 - protein, 40 aa, Artificial Sequence
  Description of Artificial Sequence: Synthetic polypeptide
HLRNREATKGFYDKDSSGWSSSKDKDAYSSFGSRSDSRGK

SEQ ID NO: 5512 - protein, 40 aa, Artificial Sequence
  Description of Artificial Sequence: Synthetic polypeptide
ATKGFYDKDSSGWSSSKDKDAYSSFGSRSDSRGKSSFFSD

SEQ ID NO: 5513 - protein, 40 aa, Artificial Sequence
  Description of Artificial Sequence: Synthetic polypeptide
TKGFYDKDSSGWSSSKDKDAYSSFGSRSDSRGKSSFFSDR

SEQ ID NO: 5514 - protein, 40 aa, Artificial Sequence
  Description of Artificial Sequence: Synthetic polypeptide
DSSGWSSSKDKDAYSSFGSRSDSRGKSSFFSDRGSGSRGR

SEQ ID NO: 5515 - protein, 40 aa, Artificial Sequence
  Description of Artificial Sequence: Synthetic polypeptide
SSGWSSSKDKDAYSSFGSRSDSRGKSSFFSDRGSGSRGRF

SEQ ID NO: 5516 - protein, 40 aa, Artificial Sequence
  Description of Artificial Sequence: Synthetic polypeptide
GWSSSKDKDAYSSFGSRSDSRGKSSFFSDRGSGSRGRFDD

SEQ ID NO: 5517 - protein, 40 aa, Artificial Sequence
  Description of Artificial Sequence: Synthetic polypeptide
PSERLEQELFSGGNTGINFEKYDDIPVEATGNNCPPHIES

SEQ ID NO: 5518 - protein, 40 aa, Artificial Sequence
  Description of Artificial Sequence: Synthetic polypeptide
RLEQELFSGGNTGINFEKYDDIPVEATGNNCPPHIESFSD

SEQ ID NO: 5519 - protein, 40 aa, Artificial Sequence
  Description of Artificial Sequence: Synthetic polypeptide
IPVEATGNNCPPHIESFSDVEMGEIIMGNIELTRYTRPTP

SEQ ID NO: 5520 - protein, 40 aa, Artificial Sequence
  Description of Artificial Sequence: Synthetic polypeptide
GNNCPPHIESFSDVEMGEIIMGNIELTRYTRPTPVQKHAI

SEQ ID NO: 5521 - protein, 40 aa, Artificial Sequence
  Description of Artificial Sequence: Synthetic polypeptide
IESFSDVEMGEIIMGNIELTRYTRPTPVQKHAIPIIKEKR

SEQ ID NO: 5522 - protein, 40 aa, Artificial Sequence
  Description of Artificial Sequence: Synthetic polypeptide
VEMGEIIMGNIELTRYTRPTPVQKHAIPIIKEKRDLMACA

SEQ ID NO: 5523 - protein, 40 aa, Artificial Sequence
  Description of Artificial Sequence: Synthetic polypeptide
EMGEIIMGNIELTRYTRPTPVQKHAIPIIKEKRDLMACAQ

SEQ ID NO: 5524 - protein, 40 aa, Artificial Sequence
  Description of Artificial Sequence: Synthetic polypeptide
EIIMGNIELTRYTRPTPVQKHAIPIIKEKRDLMACAQTGS

SEQ ID NO: 5525 - protein, 40 aa, Artificial Sequence
  Description of Artificial Sequence: Synthetic polypeptide
MGNIELTRYTRPTPVQKHAIPIIKEKRDLMACAQTGSGKT

SEQ ID NO: 5526 - protein, 40 aa, Artificial Sequence
  Description of Artificial Sequence: Synthetic polypeptide
GNIELTRYTRPTPVQKHAIPIIKEKRDLMACAQTGSGKTA

SEQ ID NO: 5527 - protein, 40 aa, Artificial Sequence
  Description of Artificial Sequence: Synthetic polypeptide
YTRPTPVQKHAIPIIKEKRDLMACAQTGSGKTAAFLLPIL

SEQ ID NO: 5528 - protein, 40 aa, Artificial Sequence
  Description of Artificial Sequence: Synthetic polypeptide
TPVQKHAIPIIKEKRDLMACAQTGSGKTAAFLLPILSQIY

SEQ ID NO: 5529 - protein, 40 aa, Artificial Sequence
  Description of Artificial Sequence: Synthetic polypeptide
IIKEKRDLMACAQTGSGKTAAFLLPILSQIYSDGPGEALR

SEQ ID NO: 5530 - protein, 40 aa, Artificial Sequence
  Description of Artificial Sequence: Synthetic polypeptide
TAAFLLPILSQIYSDGPGEALRAMKENGRYGRRKQYPISL

SEQ ID NO: 5531 - protein, 40 aa, Artificial Sequence
  Description of Artificial Sequence: Synthetic polypeptide
AAFLLPILSQIYSDGPGEALRAMKENGRYGRRKQYPISLV

SEQ ID NO: 5532 - protein, 40 aa, Artificial Sequence
  Description of Artificial Sequence: Synthetic polypeptide
AFLLPILSQIYSDGPGEALRAMKENGRYGRRKQYPISLVL

SEQ ID NO: 5533 - protein, 40 aa, Artificial Sequence
  Description of Artificial Sequence: Synthetic polypeptide
FLLPILSQIYSDGPGEALRAMKENGRYGRRKQYPISLVLA

SEQ ID NO: 5534 - protein, 40 aa, Artificial Sequence
  Description of Artificial Sequence: Synthetic polypeptide
MLPILSQIYSDGPGEALRAMKENGRYGRRKQYPISLVLAP

SEQ ID NO: 5535 - protein, 40 aa, Artificial Sequence
  Description of Artificial Sequence: Synthetic polypeptide
MPILSQIYSDGPGEALRAMKENGRYGRRKQYPISLVLAPT

SEQ ID NO: 5536 - protein, 40 aa, Artificial Sequence
  Description of Artificial Sequence: Synthetic polypeptide
PILSQIYSDGPGEALRAMKENGRYGRRKQYPISLVLAPTR

SEQ ID NO: 5537 - protein, 40 aa, Artificial Sequence
  Description of Artificial Sequence: Synthetic polypeptide
ILSQIYSDGPGEALRAMKENGRYGRRKQYPISLVLAPTRE

SEQ ID NO: 5538 - protein, 40 aa, Artificial Sequence
  Description of Artificial Sequence: Synthetic polypeptide
DGPGEALRAMKENGRYGRRKQYPISLVLAPTRELAVQIYE

SEQ ID NO: 5539 - protein, 40 aa, Artificial Sequence
  Description of Artificial Sequence: Synthetic polypeptide
PGEALRAMKENGRYGRRKQYPISLVLAPTRELAVQIYEEA

SEQ ID NO: 5540 - protein, 40 aa, Artificial Sequence
  Description of Artificial Sequence: Synthetic polypeptide
ALRAMKENGRYGRRKQYPISLVLAPTRELAVQIYEEARKF

SEQ ID NO: 5541 - protein, 40 aa, Artificial Sequence
  Description of Artificial Sequence: Synthetic polypeptide
AMKENGRYGRRKQYPISLVLAPTRELAVQIYEEARKFSYR

SEQ ID NO: 5542 - protein, 40 aa, Artificial Sequence
  Description of Artificial Sequence: Synthetic polypeptide
MKENGRYGRRKQYPISLVLAPTRELAVQIYEEARKFSYRS

SEQ ID NO: 5543 - protein, 40 aa, Artificial Sequence
  Description of Artificial Sequence: Synthetic polypeptide
KENGRYGRRKQYPISLVLAPTRELAVQIYEEARKFSYRSR

SEQ ID NO: 5544 - protein, 40 aa, Artificial Sequence
  Description of Artificial Sequence: Synthetic polypeptide
NGRYGRRKQYPISLVLAPTRELAVQIYEEARKFSYRSRVR

SEQ ID NO: 5545 - protein, 40 aa, Artificial Sequence
  Description of Artificial Sequence: Synthetic polypeptide
RRKQYPISLVLAPTRELAVQIYEEARKFSYRSRVRPCVVY

SEQ ID NO: 5546 - protein, 40 aa, Artificial Sequence
  Description of Artificial Sequence: Synthetic polypeptide
YPISLVLAPTRELAVQIYEEARKFSYRSRVRPCVVYGGAD

SEQ ID NO: 5547 - protein, 40 aa, Artificial Sequence
  Description of Artificial Sequence: Synthetic polypeptide
RGCHLLVATPGRLVDMMERGKIGLDFCKYLVLDEADRMLD

SEQ ID NO: 5548 - protein, 40 aa, Artificial Sequence
  Description of Artificial Sequence: Synthetic polypeptide
MDMGFEPQIRRIVEQDTMPPKGVRHTMMFSATFPKEIQML

SEQ ID NO: 5549 - protein, 40 aa, Artificial Sequence
  Description of Artificial Sequence: Synthetic polypeptide
RRIVEQDTMPPKGVRHTMMFSATFPKEIQMLARDFLDEYI

SEQ ID NO: 5550 - protein, 40 aa, Artificial Sequence
  Description of Artificial Sequence: Synthetic polypeptide
IVEQDTMPPKGVRHTMMFSATFPKEIQMLARDFLDEYIFL

SEQ ID NO: 5551 - protein, 40 aa, Artificial Sequence
  Description of Artificial Sequence: Synthetic polypeptide
DTMPPKGVRHTMMFSATFPKEIQMLARDFLDEYIFLAVGR

SEQ ID NO: 5552 - protein, 40 aa, Artificial Sequence
  Description of Artificial Sequence: Synthetic polypeptide
PPKGVRHTMMFSATFPKEIQMLARDFLDEYIFLAVGRVGS

SEQ ID NO: 5553 - protein, 40 aa, Artificial Sequence
  Description of Artificial Sequence: Synthetic polypeptide
PKGVRHTMMFSATFPKEIQMLARDFLDEYIFLAVGRVGST

SEQ ID NO: 5554 - protein, 40 aa, Artificial Sequence
  Description of Artificial Sequence: Synthetic polypeptide
KGVRHTMMFSATFPKEIQMLARDFLDEYIFLAVGRVGSTS

SEQ ID NO: 5555 - protein, 40 aa, Artificial Sequence
  Description of Artificial Sequence: Synthetic polypeptide
TMMFSATFPKEIQMLARDFLDEYIFLAVGRVGSTSENITQ

SEQ ID NO: 5556 - protein, 40 aa, Artificial Sequence
  Description of Artificial Sequence: Synthetic polypeptide
MFSATFPKEIQMLARDFLDEYIFLAVGRVGSTSENITQKV

SEQ ID NO: 5557 - protein, 40 aa, Artificial Sequence
  Description of Artificial Sequence: Synthetic polypeptide
ATFPKEIQMLARDFLDEYIFLAVGRVGSTSENITQKVVWV

SEQ ID NO: 5558 - protein, 40 aa, Artificial Sequence
  Description of Artificial Sequence: Synthetic polypeptide
FPKEIQMLARDFLDEYIFLAVGRVGSTSENITQKVVWVEE

SEQ ID NO: 5559 - protein, 40 aa, Artificial Sequence
  Description of Artificial Sequence: Synthetic polypeptide
KEIQMLARDFLDEYIFLAVGRVGSTSENITQKVVWVEESD

SEQ ID NO: 5560 - protein, 40 aa, Artificial Sequence
  Description of Artificial Sequence: Synthetic polypeptide
EIQMLARDFLDEYIFLAVGRVGSTSENITQKVVWVEESDK

SEQ ID NO: 5561 - protein, 40 aa, Artificial Sequence
  Description of Artificial Sequence: Synthetic polypeptide
IQMLARDFLDEYIFLAVGRVGSTSENITQKVVWVEESDKR

SEQ ID NO: 5562 - protein, 40 aa, Artificial Sequence
  Description of Artificial Sequence: Synthetic polypeptide
RDFLDEYIFLAVGRVGSTSENITQKVVWVEESDKRSFLLD

SEQ ID NO: 5563 - protein, 40 aa, Artificial Sequence
  Description of Artificial Sequence: Synthetic polypeptide
FLDEYIFLAVGRVGSTSENITQKVVWVEESDKRSFLLDLL

SEQ ID NO: 5564 - protein, 40 aa, Artificial Sequence
  Description of Artificial Sequence: Synthetic polypeptide
IFLAVGRVGSTSENITQKVVWVEESDKRSFLLDLLNATGK

SEQ ID NO: 5565 - protein, 40 aa, Artificial Sequence
  Description of Artificial Sequence: Synthetic polypeptide
RVGSTSENITQKVVWVEESDKRSFLLDLLNATGKDSLTLV

SEQ ID NO: 5566 - protein, 40 aa, Artificial Sequence
  Description of Artificial Sequence: Synthetic polypeptide
KVVWVEESDKRSFLLDLLNATGKDSLTLVFVETKKGADSL

SEQ ID NO: 5567 - protein, 40 aa, Artificial Sequence
  Description of Artificial Sequence: Synthetic polypeptide
ESDKRSFLLDLLNATGKDSLTLVFVETKKGADSLEDFLYH

SEQ ID NO: 5568 - protein, 40 aa, Artificial Sequence
  Description of Artificial Sequence: Synthetic polypeptide
SFLLDLLNATGKDSLTLVFVETKKGADSLEDFLYHEGYAC

SEQ ID NO: 5569 - protein, 40 aa, Artificial Sequence
  Description of Artificial Sequence: Synthetic polypeptide
GKDSLTLVFVETKKGADSLEDFLYHEGYACTSIHGDRSQR

SEQ ID NO: 5570 - protein, 40 aa, Artificial Sequence
  Description of Artificial Sequence: Synthetic polypeptide
NVKHVINFDLPSDIEEYVHRIGRTGRVGNLGLATSFFNER

SEQ ID NO: 5571 - protein, 40 aa, Artificial Sequence
  Description of Artificial Sequence: Synthetic polypeptide
NFDLPSDIEEYVHRIGRTGRVGNLGLATSFFNERNINITK

SEQ ID NO: 5572 - protein, 40 aa, Artificial Sequence
  Description of Artificial Sequence: Synthetic polypeptide
FDLPSDIEEYVHRIGRTGRVGNLGLATSFFNERNINITKD

SEQ ID NO: 5573 - protein, 40 aa, Artificial Sequence
  Description of Artificial Sequence: Synthetic polypeptide
MPSDIEEYVHRIGRTGRVGNLGLATSFFNERNINITKDLL

SEQ ID NO: 5574 - protein, 40 aa, Artificial Sequence
  Description of Artificial Sequence: Synthetic polypeptide
HRIGRTGRVGNLGLATSFFNERNINITKDLLDLLVEAKQE

SEQ ID NO: 5575 - protein, 40 aa, Artificial Sequence
  Description of Artificial Sequence: Synthetic polypeptide
TGRVGNLGLATSFFNERNINITKDLLDLLVEAKQEVPSWL

SEQ ID NO: 5576 - protein, 40 aa, Artificial Sequence
  Description of Artificial Sequence: Synthetic polypeptide
VGNLGLATSFFNERNINITKDLLDLLVEAKQEVPSWLENM

SEQ ID NO: 5577 - protein, 40 aa, Artificial Sequence
  Description of Artificial Sequence: Synthetic polypeptide
GNLGLATSFFNERNINITKDLLDLLVEAKQEVPSWLENMA

SEQ ID NO: 5578 - protein, 40 aa, Artificial Sequence
  Description of Artificial Sequence: Synthetic polypeptide
LGLATSFFNERNINITKDLLDLLVEAKQEVPSWLENMAYE

SEQ ID NO: 5579 - protein, 40 aa, Artificial Sequence
  Description of Artificial Sequence: Synthetic polypeptide
MATSFFNERNINITKDLLDLLVEAKQEVPSWLENMAYEHH

SEQ ID NO: 5580 - protein, 40 aa, Artificial Sequence
  Description of Artificial Sequence: Synthetic polypeptide
TSFFNERNINITKDLLDLLVEAKQEVPSWLENMAYEHHYK

SEQ ID NO: 5581 - protein, 40 aa, Artificial Sequence
  Description of Artificial Sequence: Synthetic polypeptide
NERNINITKDLLDLLVEAKQEVPSWLENMAYEHHYKGSSR

SEQ ID NO: 5582 - protein, 40 aa, Artificial Sequence
  Description of Artificial Sequence: Synthetic polypeptide
PSWLENMAYEHHYKGSSRGRSKSSRFSGGFGARDYRQSSG

SEQ ID NO: 5583 - protein, 40 aa, Artificial Sequence
  Description of Artificial Sequence: Synthetic polypeptide
MQPLSMAGLQLMTPASSPMGPFFGLPWQQEAIHDNIYTPR

SEQ ID NO: 5584 - protein, 40 aa, Artificial Sequence
  Description of Artificial Sequence: Synthetic polypeptide
PLSMAGLQLMTPASSPMGPFFGLPWQQEAIHDNIYTPRKY

SEQ ID NO: 5585 - protein, 40 aa, Artificial Sequence
  Description of Artificial Sequence: Synthetic polypeptide
SMAGLQLMTPASSPMGPFFGLPWQQEAIHDNIYTPRKYQV

SEQ ID NO: 5586 - protein, 40 aa, Artificial Sequence
  Description of Artificial Sequence: Synthetic polypeptide
MTPASSPMGPFFGLPWQQEAIHDNIYTPRKYQVELLEAAL

SEQ ID NO: 5587 - protein, 40 aa, Artificial Sequence
  Description of Artificial Sequence: Synthetic polypeptide
PWQQEAIHDNIYTPRKYQVELLEAALDHNTIVCLNTGSGK

SEQ ID NO: 5588 - protein, 40 aa, Artificial Sequence
  Description of Artificial Sequence: Synthetic polypeptide
YQVELLEAALDHNTIVCLNTGSGKTFIAVLLTKELSYQIR

SEQ ID NO: 5589 - protein, 40 aa, Artificial Sequence
  Description of Artificial Sequence: Synthetic polypeptide
MDHNTIVCLNTGSGKTFIAVLLTKELSYQIRGDFSRNGKR

SEQ ID NO: 5590 - protein, 40 aa, Artificial Sequence
  Description of Artificial Sequence: Synthetic polypeptide
VGEYSNLEVNASWTKERWNQEFTKHQVLIMTCYVALNVLK

SEQ ID NO: 5591 - protein, 40 aa, Artificial Sequence
  Description of Artificial Sequence: Synthetic polypeptide
NLEVNASWTKERWNQEFTKHQVLIMTCYVALNVLKNGYLS

SEQ ID NO: 5592 - protein, 40 aa, Artificial Sequence
  Description of Artificial Sequence: Synthetic polypeptide
EVNASWTKERWNQEFTKHQVLIMTCYVALNVLKNGYLSLS

SEQ ID NO: 5593 - protein, 40 aa, Artificial Sequence
  Description of Artificial Sequence: Synthetic polypeptide
VNASWTKERWNQEFTKHQVLIMTCYVALNVLKNGYLSLSD

SEQ ID NO: 5594 - protein, 40 aa, Artificial Sequence
  Description of Artificial Sequence: Synthetic polypeptide
KERWNQEFTKHQVLIMTCYVALNVLKNGYLSLSDINLLVF

SEQ ID NO: 5595 - protein, 40 aa, Artificial Sequence
  Description of Artificial Sequence: Synthetic polypeptide
ERWNQEFTKHQVLIMTCYVALNVLKNGYLSLSDINLLVFD

SEQ ID NO: 5596 - protein, 40 aa, Artificial Sequence
  Description of Artificial Sequence: Synthetic polypeptide
WNQEFTKHQVLIMTCYVALNVLKNGYLSLSDINLLVFDEC

SEQ ID NO: 5597 - protein, 40 aa, Artificial Sequence
  Description of Artificial Sequence: Synthetic polypeptide
QEFTKHQVLIMTCYVALNVLKNGYLSLSDINLLVFDECHL

SEQ ID NO: 5598 - protein, 40 aa, Artificial Sequence
  Description of Artificial Sequence: Synthetic polypeptide
EFTKHQVLIMTCYVALNVLKNGYLSLSDINLLVFDECHLA

SEQ ID NO: 5599 - protein, 40 aa, Artificial Sequence
  Description of Artificial Sequence: Synthetic polypeptide
FTKHQVLIMTCYVALNVLKNGYLSLSDINLLVFDECHLAI

SEQ ID NO: 5600 - protein, 40 aa, Artificial Sequence
  Description of Artificial Sequence: Synthetic polypeptide
TKHQVLIMTCYVALNVLKNGYLSLSDINLLVFDECHLAIL

SEQ ID NO: 5601 - protein, 40 aa, Artificial Sequence
  Description of Artificial Sequence: Synthetic polypeptide
KHQVLIMTCYVALNVLKNGYLSLSDINLLVFDECHLAILD

SEQ ID NO: 5602 - protein, 40 aa, Artificial Sequence
  Description of Artificial Sequence: Synthetic polypeptide
HQVLIMTCYVALNVLKNGYLSLSDINLLVFDECHLAILDH

SEQ ID NO: 5603 - protein, 40 aa, Artificial Sequence
  Description of Artificial Sequence: Synthetic polypeptide
VLIMTCYVALNVLKNGYLSLSDINLLVFDECHLAILDHPY

SEQ ID NO: 5604 - protein, 40 aa, Artificial Sequence
  Description of Artificial Sequence: Synthetic polypeptide
LIMTCYVALNVLKNGYLSLSDINLLVFDECHLAILDHPYR

SEQ ID NO: 5605 - protein, 40 aa, Artificial Sequence
  Description of Artificial Sequence: Synthetic polypeptide
CYVALNVLKNGYLSLSDINLLVFDECHLAILDHPYREIMK

SEQ ID NO: 5606 - protein, 40 aa, Artificial Sequence
  Description of Artificial Sequence: Synthetic polypeptide
YVALNVLKNGYLSLSDINLLVFDECHLAILDHPYREIMKL

SEQ ID NO: 5607 - protein, 40 aa, Artificial Sequence
  Description of Artificial Sequence: Synthetic polypeptide
NVLKNGYLSLSDINLLVFDECHLAILDHPYREIMKLCENC

SEQ ID NO: 5608 - protein, 40 aa, Artificial Sequence
  Description of Artificial Sequence: Synthetic polypeptide
IMKLCENCPSCPRILGLTASILNGKCDPEELEEKIQKLEK

SEQ ID NO: 5609 - protein, 40 aa, Artificial Sequence
  Description of Artificial Sequence: Synthetic polypeptide
MKLCENCPSCPRILGLTASILNGKCDPEELEEKIQKLEKI

SEQ ID NO: 5610 - protein, 40 aa, Artificial Sequence
  Description of Artificial Sequence: Synthetic polypeptide
LCENCPSCPRILGLTASILNGKCDPEELEEKIQKLEKILK

SEQ ID NO: 5611 - protein, 40 aa, Artificial Sequence
  Description of Artificial Sequence: Synthetic polypeptide
PSCPRILGLTASILNGKCDPEELEEKIQKLEKILKSNAET

SEQ ID NO: 5612 - protein, 40 aa, Artificial Sequence
  Description of Artificial Sequence: Synthetic polypeptide
MGLTASILNGKCDPEELEEKIQKLEKILKSNAETATDLVV

SEQ ID NO: 5613 - protein, 40 aa, Artificial Sequence
  Description of Artificial Sequence: Synthetic polypeptide
ASILNGKCDPEELEEKIQKLEKILKSNAETATDLVVLDRY

SEQ ID NO: 5614 - protein, 40 aa, Artificial Sequence
  Description of Artificial Sequence: Synthetic polypeptide
SILNGKCDPEELEEKIQKLEKILKSNAETATDLVVLDRYT

SEQ ID NO: 5615 - protein, 40 aa, Artificial Sequence
  Description of Artificial Sequence: Synthetic polypeptide
ILNGKCDPEELEEKIQKLEKILKSNAETATDLVVLDRYTS

SEQ ID NO: 5616 - protein, 40 aa, Artificial Sequence
  Description of Artificial Sequence: Synthetic polypeptide
LNGKCDPEELEEKIQKLEKILKSNAETATDLVVLDRYTSQ

SEQ ID NO: 5617 - protein, 40 aa, Artificial Sequence
  Description of Artificial Sequence: Synthetic polypeptide
KCDPEELEEKIQKLEKILKSNAETATDLVVLDRYTSQPCE

SEQ ID NO: 5618 - protein, 40 aa, Artificial Sequence
  Description of Artificial Sequence: Synthetic polypeptide
LKSNAETATDLVVLDRYTSQPCEIVVDCGPFTDRSGLYER

SEQ ID NO: 5619 - protein, 40 aa, Artificial Sequence
  Description of Artificial Sequence: Synthetic polypeptide
ATDLVVLDRYTSQPCEIVVDCGPFTDRSGLYERLLMELEE

SEQ ID NO: 5620 - protein, 40 aa, Artificial Sequence
  Description of Artificial Sequence: Synthetic polypeptide
DCGPFTDRSGLYERLLMELEEALNFINDCNISVHSKERDS

SEQ ID NO: 5621 - protein, 40 aa, Artificial Sequence
  Description of Artificial Sequence: Synthetic polypeptide
FTDRSGLYERLLMELEEALNFINDCNISVHSKERDSTLIS

SEQ ID NO: 5622 - protein, 40 aa, Artificial Sequence
  Description of Artificial Sequence: Synthetic polypeptide
TDRSGLYERLLMELEEALNFINDCNISVHSKERDSTLISK

SEQ ID NO: 5623 - protein, 40 aa, Artificial Sequence
  Description of Artificial Sequence: Synthetic polypeptide
RSGLYERLLMELEEALNFINDCNISVHSKERDSTLISKQI

SEQ ID NO: 5624 - protein, 40 aa, Artificial Sequence
  Description of Artificial Sequence: Synthetic polypeptide
GLYERLLMELEEALNFINDCNISVHSKERDSTLISKQILS

SEQ ID NO: 5625 - protein, 40 aa, Artificial Sequence
  Description of Artificial Sequence: Synthetic polypeptide
LYERLLMELEEALNFINDCNISVHSKERDSTLISKQILSD

SEQ ID NO: 5626 - protein, 40 aa, Artificial Sequence
  Description of Artificial Sequence: Synthetic polypeptide
YERLLMELEEALNFINDCNISVHSKERDSTLISKQILSDC

SEQ ID NO: 5627 - protein, 40 aa, Artificial Sequence
  Description of Artificial Sequence: Synthetic polypeptide
ERLLMELEEALNFINDCNISVHSKERDSTLISKQILSDCR

SEQ ID NO: 5628 - protein, 40 aa, Artificial Sequence
  Description of Artificial Sequence: Synthetic polypeptide
MLMELEEALNFINDCNISVHSKERDSTLISKQILSDCRAV

SEQ ID NO: 5629 - protein, 40 aa, Artificial Sequence
  Description of Artificial Sequence: Synthetic polypeptide
MMELEEALNFINDCNISVHSKERDSTLISKQILSDCRAVL

SEQ ID NO: 5630 - protein, 40 aa, Artificial Sequence
  Description of Artificial Sequence: Synthetic polypeptide
MELEEALNFINDCNISVHSKERDSTLISKQILSDCRAVLV

SEQ ID NO: 5631 - protein, 40 aa, Artificial Sequence
  Description of Artificial Sequence: Synthetic polypeptide
EEALNFINDCNISVHSKERDSTLISKQILSDCRAVLVVLG

SEQ ID NO: 5632 - protein, 40 aa, Artificial Sequence
  Description of Artificial Sequence: Synthetic polypeptide
EALNFINDCNISVHSKERDSTLISKQILSDCRAVLVVLGP

SEQ ID NO: 5633 - protein, 40 aa, Artificial Sequence
  Description of Artificial Sequence: Synthetic polypeptide
FINDCNISVHSKERDSTLISKQILSDCRAVLVVLGPWCAD

SEQ ID NO: 5634 - protein, 40 aa, Artificial Sequence
  Description of Artificial Sequence: Synthetic polypeptide
INDCNISVHSKERDSTLISKQILSDCRAVLVVLGPWCADK

SEQ ID NO: 5635 - protein, 40 aa, Artificial Sequence
  Description of Artificial Sequence: Synthetic polypeptide
DCNISVHSKERDSTLISKQILSDCRAVLVVLGPWCADKVA

SEQ ID NO: 5636 - protein, 40 aa, Artificial Sequence
  Description of Artificial Sequence: Synthetic polypeptide
VHSKERDSTLISKQILSDCRAVLVVLGPWCADKVAGMMVR

SEQ ID NO: 5637 - protein, 40 aa, Artificial Sequence
  Description of Artificial Sequence: Synthetic polypeptide
SKERDSTLISKQILSDCRAVLVVLGPWCADKVAGMMVREL

SEQ ID NO: 5638 - protein, 40 aa, Artificial Sequence
  Description of Artificial Sequence: Synthetic polypeptide
KERDSTLISKQILSDCRAVLVVLGPWCADKVAGMMVRELQ

SEQ ID NO: 5639 - protein, 40 aa, Artificial Sequence
  Description of Artificial Sequence: Synthetic polypeptide
DSTLISKQILSDCRAVLVVLGPWCADKVAGMMVRELQKYI

SEQ ID NO: 5640 - protein, 40 aa, Artificial Sequence
  Description of Artificial Sequence: Synthetic polypeptide
TLISKQILSDCRAVLVVLGPWCADKVAGMMVRELQKYIKH

SEQ ID NO: 5641 - protein, 40 aa, Artificial Sequence
  Description of Artificial Sequence: Synthetic polypeptide
LISKQILSDCRAVLVVLGPWCADKVAGMMVRELQKYIKHE

SEQ ID NO: 5642 - protein, 40 aa, Artificial Sequence
  Description of Artificial Sequence: Synthetic polypeptide
ISKQILSDCRAVLVVLGPWCADKVAGMMVRELQKYIKHEQ

SEQ ID NO: 5643 - protein, 40 aa, Artificial Sequence
  Description of Artificial Sequence: Synthetic polypeptide
SKQILSDCRAVLVVLGPWCADKVAGMMVRELQKYIKHEQE

SEQ ID NO: 5644 - protein, 40 aa, Artificial Sequence
  Description of Artificial Sequence: Synthetic polypeptide
ILSDCRAVLVVLGPWCADKVAGMMVRELQKYIKHEQEELH

SEQ ID NO: 5645 - protein, 40 aa, Artificial Sequence
  Description of Artificial Sequence: Synthetic polypeptide
CRAVLVVLGPWCADKVAGMMVRELQKYIKHEQEELHRKFL

SEQ ID NO: 5646 - protein, 40 aa, Artificial Sequence
  Description of Artificial Sequence: Synthetic polypeptide
RAVLVVLGPWCADKVAGMMVRELQKYIKHEQEELHRKFLL

SEQ ID NO: 5647 - protein, 40 aa, Artificial Sequence
  Description of Artificial Sequence: Synthetic polypeptide
VLVVLGPWCADKVAGMMVRELQKYIKHEQEELHRKFLLFT

SEQ ID NO: 5648 - protein, 40 aa, Artificial Sequence
  Description of Artificial Sequence: Synthetic polypeptide
MVVLGPWCADKVAGMMVRELQKYIKHEQEELHRKFLLFTD

SEQ ID NO: 5649 - protein, 40 aa, Artificial Sequence
  Description of Artificial Sequence: Synthetic polypeptide
WCADKVAGMMVRELQKYIKHEQEELHRKFLLFTDTFLRKI

SEQ ID NO: 5650 - protein, 40 aa, Artificial Sequence
  Description of Artificial Sequence: Synthetic polypeptide
HRKFLLFTDTFLRKIHALCEEHFSPASLDLKFVTPKVIKL

SEQ ID NO: 5651 - protein, 40 aa, Artificial Sequence
  Description of Artificial Sequence: Synthetic polypeptide
RKFLLFTDTFLRKIHALCEEHFSPASLDLKFVTPKVIKLL

SEQ ID NO: 5652 - protein, 40 aa, Artificial Sequence
  Description of Artificial Sequence: Synthetic polypeptide
KFLLFTDTFLRKIHALCEEHFSPASLDLKFVTPKVIKLLE

SEQ ID NO: 5653 - protein, 40 aa, Artificial Sequence
  Description of Artificial Sequence: Synthetic polypeptide
FLLFTDTFLRKIHALCEEHFSPASLDLKFVTPKVIKLLEI

SEQ ID NO: 5654 - protein, 40 aa, Artificial Sequence
  Description of Artificial Sequence: Synthetic polypeptide
LLFTDTFLRKIHALCEEHFSPASLDLKFVTPKVIKLLEIL

SEQ ID NO: 5655 - protein, 40 aa, Artificial Sequence
  Description of Artificial Sequence: Synthetic polypeptide
FTDTFLRKIHALCEEHFSPASLDLKFVTPKVIKLLEILRK

SEQ ID NO: 5656 - protein, 40 aa, Artificial Sequence
  Description of Artificial Sequence: Synthetic polypeptide
KIHALCEEHFSPASLDLKFVTPKVIKLLEILRKYKPYERQ

SEQ ID NO: 5657 - protein, 40 aa, Artificial Sequence
  Description of Artificial Sequence: Synthetic polypeptide
IHALCEEHFSPASLDLKFVTPKVIKLLEILRKYKPYERQQ

SEQ ID NO: 5658 - protein, 40 aa, Artificial Sequence
  Description of Artificial Sequence: Synthetic polypeptide
CEEHFSPASLDLKFVTPKVIKLLEILRKYKPYERQQFESV

SEQ ID NO: 5659 - protein, 40 aa, Artificial Sequence
  Description of Artificial Sequence: Synthetic polypeptide
EEHFSPASLDLKFVTPKVIKLLEILRKYKPYERQQFESVE

SEQ ID NO: 5660 - protein, 40 aa, Artificial Sequence
  Description of Artificial Sequence: Synthetic polypeptide
FSPASLDLKFVTPKVIKLLEILRKYKPYERQQFESVEWYN

SEQ ID NO: 5661 - protein, 40 aa, Artificial Sequence
  Description of Artificial Sequence: Synthetic polypeptide
PASLDLKFVTPKVIKLLEILRKYKPYERQQFESVEWYNNR

SEQ ID NO: 5662 - protein, 40 aa, Artificial Sequence
  Description of Artificial Sequence: Synthetic polypeptide
ASLDLKFVTPKVIKLLEILRKYKPYERQQFESVEWYNNRN

SEQ ID NO: 5663 - protein, 40 aa, Artificial Sequence
  Description of Artificial Sequence: Synthetic polypeptide
LDLKFVTPKVIKLLEILRKYKPYERQQFESVEWYNNRNQD

SEQ ID NO: 5664 - protein, 40 aa, Artificial Sequence
  Description of Artificial Sequence: Synthetic polypeptide
KFVTPKVIKLLEILRKYKPYERQQFESVEWYNNRNQDNYV

SEQ ID NO: 5665 - protein, 40 aa, Artificial Sequence
  Description of Artificial Sequence: Synthetic polypeptide
TPKVIKLLEILRKYKPYERQQFESVEWYNNRNQDNYVSWS

SEQ ID NO: 5666 - protein, 40 aa, Artificial Sequence
  Description of Artificial Sequence: Synthetic polypeptide
PKVIKLLEILRKYKPYERQQFESVEWYNNRNQDNYVSWSD

SEQ ID NO: 5667 - protein, 40 aa, Artificial Sequence
  Description of Artificial Sequence: Synthetic polypeptide
ILRKYKPYERQQFESVEWYNNRNQDNYVSWSDSEDDDEDE

SEQ ID NO: 5668 - protein, 40 aa, Artificial Sequence
  Description of Artificial Sequence: Synthetic polypeptide
RKYKPYERQQFESVEWYNNRNQDNYVSWSDSEDDDEDEEI

SEQ ID NO: 5669 - protein, 40 aa, Artificial Sequence
  Description of Artificial Sequence: Synthetic polypeptide
KYKPYERQQFESVEWYNNRNQDNYVSWSDSEDDDEDEEIE

SEQ ID NO: 5670 - protein, 40 aa, Artificial Sequence
  Description of Artificial Sequence: Synthetic polypeptide
YKPYERQQFESVEWYNNRNQDNYVSWSDSEDDDEDEEIEE

SEQ ID NO: 5671 - protein, 40 aa, Artificial Sequence
  Description of Artificial Sequence: Synthetic polypeptide
QQFESVEWYNNRNQDNYVSWSDSEDDDEDEEIEEKEKPET

SEQ ID NO: 5672 - protein, 40 aa, Artificial Sequence
  Description of Artificial Sequence: Synthetic polypeptide
ESVEWYNNRNQDNYVSWSDSEDDDEDEEIEEKEKPETNFP

SEQ ID NO: 5673 - protein, 40 aa, Artificial Sequence
  Description of Artificial Sequence: Synthetic polypeptide
SVEWYNNRNQDNYVSWSDSEDDDEDEEIEEKEKPETNFPS

SEQ ID NO: 5674 - protein, 40 aa, Artificial Sequence
  Description of Artificial Sequence: Synthetic polypeptide
VEWYNNRNQDNYVSWSDSEDDDEDEEIEEKEKPETNFPSP

SEQ ID NO: 5675 - protein, 40 aa, Artificial Sequence
  Description of Artificial Sequence: Synthetic polypeptide
EWYNNRNQDNYVSWSDSEDDDEDEEIEEKEKPETNFPSPF

SEQ ID NO: 5676 - protein, 40 aa, Artificial Sequence
  Description of Artificial Sequence: Synthetic polypeptide
YNNRNQDNYVSWSDSEDDDEDEEIEEKEKPETNFPSPFTN

SEQ ID NO: 5677 - protein, 40 aa, Artificial Sequence
  Description of Artificial Sequence: Synthetic polypeptide
NNRNQDNYVSWSDSEDDDEDEEIEEKEKPETNFPSPFTNI

SEQ ID NO: 5678 - protein, 40 aa, Artificial Sequence
  Description of Artificial Sequence: Synthetic polypeptide
NRNQDNYVSWSDSEDDDEDEEIEEKEKPETNFPSPFTNIL

SEQ ID NO: 5679 - protein, 40 aa, Artificial Sequence
  Description of Artificial Sequence: Synthetic polypeptide
NQDNYVSWSDSEDDDEDEEIEEKEKPETNFPSPFTNILCG

SEQ ID NO: 5680 - protein, 40 aa, Artificial Sequence
  Description of Artificial Sequence: Synthetic polypeptide
WSDSEDDDEDEEIEEKEKPETNFPSPFTNILCGIIFVERR

SEQ ID NO: 5681 - protein, 40 aa, Artificial Sequence
  Description of Artificial Sequence: Synthetic polypeptide
DEDEEIEEKEKPETNFPSPFTNILCGIIFVERRYTAVVLN

SEQ ID NO: 5682 - protein, 40 aa, Artificial Sequence
  Description of Artificial Sequence: Synthetic polypeptide
EIEEKEKPETNFPSPFTNILCGIIFVERRYTAVVLNRLIK

SEQ ID NO: 5683 - protein, 40 aa, Artificial Sequence
  Description of Artificial Sequence: Synthetic polypeptide
EEKEKPETNFPSPFTNILCGIIFVERRYTAVVLNRLIKEA

SEQ ID NO: 5684 - protein, 40 aa, Artificial Sequence
  Description of Artificial Sequence: Synthetic polypeptide
KEKPETNFPSPFTNILCGIIFVERRYTAVVLNRLIKEAGK

SEQ ID NO: 5685 - protein, 40 aa, Artificial Sequence
  Description of Artificial Sequence: Synthetic polypeptide
TNFPSPFTNILCGIIFVERRYTAVVLNRLIKEAGKQDPEL

SEQ ID NO: 5686 - protein, 40 aa, Artificial Sequence
  Description of Artificial Sequence: Synthetic polypeptide
NFPSPFTNILCGIIFVERRYTAVVLNRLIKEAGKQDPELA

SEQ ID NO: 5687 - protein, 40 aa, Artificial Sequence
  Description of Artificial Sequence: Synthetic polypeptide
FPSPFTNILCGIIFVERRYTAVVLNRLIKEAGKQDPELAY

SEQ ID NO: 5688 - protein, 40 aa, Artificial Sequence
  Description of Artificial Sequence: Synthetic polypeptide
PSPFTNILCGIIFVERRYTAVVLNRLIKEAGKQDPELAYI

SEQ ID NO: 5689 - protein, 40 aa, Artificial Sequence
  Description of Artificial Sequence: Synthetic polypeptide
SPFTNILCGIIFVERRYTAVVLNRLIKEAGKQDPELAYIS

SEQ ID NO: 5690 - protein, 40 aa, Artificial Sequence
  Description of Artificial Sequence: Synthetic polypeptide
MCGIIFVERRYTAVVLNRLIKEAGKQDPELAYISSNFITG

SEQ ID NO: 5691 - protein, 40 aa, Artificial Sequence
  Description of Artificial Sequence: Synthetic polypeptide
CGIIFVERRYTAVVLNRLIKEAGKQDPELAYISSNFITGH

SEQ ID NO: 5692 - protein, 40 aa, Artificial Sequence
  Description of Artificial Sequence: Synthetic polypeptide
KQDPELAYISSNFITGHGIGKNQPRNKQMEAEFRKQEEVL

SEQ ID NO: 5693 - protein, 40 aa, Artificial Sequence
  Description of Artificial Sequence: Synthetic polypeptide
ITGHGIGKNQPRNKQMEAEFRKQEEVLRKFRAHETNLLIA

SEQ ID NO: 5694 - protein, 40 aa, Artificial Sequence
  Description of Artificial Sequence: Synthetic polypeptide
QMEAEFRKQEEVLRKFRAHETNLLIATSIVEEGVDIPKCN

SEQ ID NO: 5695 - protein, 40 aa, Artificial Sequence
  Description of Artificial Sequence: Synthetic polypeptide
AEFRKQEEVLRKFRAHETNLLIATSIVEEGVDIPKCNLVV

SEQ ID NO: 5696 - protein, 40 aa, Artificial Sequence
  Description of Artificial Sequence: Synthetic polypeptide
FRAHETNLLIATSIVEEGVDIPKCNLVVRFDLPTEYRSYV

SEQ ID NO: 5697 - protein, 40 aa, Artificial Sequence
  Description of Artificial Sequence: Synthetic polypeptide
MLIATSIVEEGVDIPKCNLVVRFDLPTEYRSYVQSKGRAR

SEQ ID NO: 5698 - protein, 40 aa, Artificial Sequence
  Description of Artificial Sequence: Synthetic polypeptide
IATSIVEEGVDIPKCNLVVRFDLPTEYRSYVQSKGRARAP

SEQ ID NO: 5699 - protein, 40 aa, Artificial Sequence
  Description of Artificial Sequence: Synthetic polypeptide
TSIVEEGVDIPKCNLVVRFDLPTEYRSYVQSKGRARAPIS

SEQ ID NO: 5700 - protein, 40 aa, Artificial Sequence
  Description of Artificial Sequence: Synthetic polypeptide
SIVEEGVDIPKCNLVVRFDLPTEYRSYVQSKGRARAPISN

SEQ ID NO: 5701 - protein, 40 aa, Artificial Sequence
  Description of Artificial Sequence: Synthetic polypeptide
IVEEGVDIPKCNLVVRFDLPTEYRSYVQSKGRARAPISNY

SEQ ID NO: 5702 - protein, 40 aa, Artificial Sequence
  Description of Artificial Sequence: Synthetic polypeptide
EEGVDIPKCNLVVRFDLPTEYRSYVQSKGRARAPISNYIM

SEQ ID NO: 5703 - protein, 40 aa, Artificial Sequence
  Description of Artificial Sequence: Synthetic polypeptide
GVDIPKCNLVVRFDLPTEYRSYVQSKGRARAPISNYIMLA

SEQ ID NO: 5704 - protein, 40 aa, Artificial Sequence
  Description of Artificial Sequence: Synthetic polypeptide
VDIPKCNLVVRFDLPTEYRSYVQSKGRARAPISNYIMLAD

SEQ ID NO: 5705 - protein, 40 aa, Artificial Sequence
  Description of Artificial Sequence: Synthetic polypeptide
PKCNLVVRFDLPTEYRSYVQSKGRARAPISNYIMLADTDK

SEQ ID NO: 5706 - protein, 40 aa, Artificial Sequence
  Description of Artificial Sequence: Synthetic polypeptide
CNLVVRFDLPTEYRSYVQSKGRARAPISNYIMLADTDKIK

SEQ ID NO: 5707 - protein, 40 aa, Artificial Sequence
  Description of Artificial Sequence: Synthetic polypeptide
ADTDKIKSFEEDLKTYKAIEKILRNKCSKSVDTGETDIDP

SEQ ID NO: 5708 - protein, 40 aa, Artificial Sequence
  Description of Artificial Sequence: Synthetic polypeptide
TDKIKSFEEDLKTYKAIEKILRNKCSKSVDTGETDIDPVM

SEQ ID NO: 5709 - protein, 40 aa, Artificial Sequence
  Description of Artificial Sequence: Synthetic polypeptide
DKIKSFEEDLKTYKAIEKILRNKCSKSVDTGETDIDPVMD

SEQ ID NO: 5710 - protein, 40 aa, Artificial Sequence
  Description of Artificial Sequence: Synthetic polypeptide
NRYCARLPSDPFTHLAPKCRTRELPDGTFYSTLYLPINSP

SEQ ID NO: 5711 - protein, 40 aa, Artificial Sequence
  Description of Artificial Sequence: Synthetic polypeptide
RLPSDPFTHLAPKCRTRELPDGTFYSTLYLPINSPLRASI

SEQ ID NO: 5712 - protein, 40 aa, Artificial Sequence
  Description of Artificial Sequence: Synthetic polypeptide
ELPDGTFYSTLYLPINSPLRASIVGPPMSCVRLAERVVAL

SEQ ID NO: 5713 - protein, 40 aa, Artificial Sequence
  Description of Artificial Sequence: Synthetic polypeptide
TFYSTLYLPINSPLRASIVGPPMSCVRLAERVVALICCEK

SEQ ID NO: 5714 - protein, 40 aa, Artificial Sequence
  Description of Artificial Sequence: Synthetic polypeptide
SIVGPPMSCVRLAERVVALICCEKLHKIGELDDHLMPVGK

SEQ ID NO: 5715 - protein, 40 aa, Artificial Sequence
  Description of Artificial Sequence: Synthetic polypeptide
ERVVALICCEKLHKIGELDDHLMPVGKETVKYEEELDLHD

SEQ ID NO: 5716 - protein, 40 aa, Artificial Sequence
  Description of Artificial Sequence: Synthetic polypeptide
KLHKIGELDDHLMPVGKETVKYEEELDLHDEEETSVPGRP

SEQ ID NO: 5717 - protein, 40 aa, Artificial Sequence
  Description of Artificial Sequence: Synthetic polypeptide
DHLMPVGKETVKYEEELDLHDEEETSVPGRPGSTKRRQCY

SEQ ID NO: 5718 - protein, 40 aa, Artificial Sequence
  Description of Artificial Sequence: Synthetic polypeptide
TVKYEEELDLHDEEETSVPGRPGSTKRRQCYPKAIPECLR

SEQ ID NO: 5719 - protein, 40 aa, Artificial Sequence
  Description of Artificial Sequence: Synthetic polypeptide
PECLRDSYPRPDQPCYLYVIGMVLTTPLPDELNFRRRKLY

SEQ ID NO: 5720 - protein, 40 aa, Artificial Sequence
  Description of Artificial Sequence: Synthetic polypeptide
TAKPIPQIPHFPVYTRSGEVTISIELKKSGFMLSLQMLEL

SEQ ID NO: 5721 - protein, 40 aa, Artificial Sequence
  Description of Artificial Sequence: Synthetic polypeptide
QIPHFPVYTRSGEVTISIELKKSGFMLSLQMLELITRLHQ

SEQ ID NO: 5722 - protein, 40 aa, Artificial Sequence
  Description of Artificial Sequence: Synthetic polypeptide
PHFPVYTRSGEVTISIELKKSGFMLSLQMLELITRLHQYI

SEQ ID NO: 5723 - protein, 40 aa, Artificial Sequence
  Description of Artificial Sequence: Synthetic polypeptide
HFPVYTRSGEVTISIELKKSGFMLSLQMLELITRLHQYIF

SEQ ID NO: 5724 - protein, 40 aa, Artificial Sequence
  Description of Artificial Sequence: Synthetic polypeptide
PVYTRSGEVTISIELKKSGFMLSLQMLELITRLHQYIFSH

SEQ ID NO: 5725 - protein, 40 aa, Artificial Sequence
  Description of Artificial Sequence: Synthetic polypeptide
YTRSGEVTISIELKKSGFMLSLQMLELITRLHQYIFSHIL

SEQ ID NO: 5726 - protein, 40 aa, Artificial Sequence
  Description of Artificial Sequence: Synthetic polypeptide
RSGEVTISIELKKSGFMLSLQMLELITRLHQYIFSHILRL

SEQ ID NO: 5727 - protein, 40 aa, Artificial Sequence
  Description of Artificial Sequence: Synthetic polypeptide
EVTISIELKKSGFMLSLQMLELITRLHQYIFSHILRLEKP

SEQ ID NO: 5728 - protein, 40 aa, Artificial Sequence
  Description of Artificial Sequence: Synthetic polypeptide
TISIELKKSGFMLSLQMLELITRLHQYIFSHILRLEKPAL

SEQ ID NO: 5729 - protein, 40 aa, Artificial Sequence
  Description of Artificial Sequence: Synthetic polypeptide
SGFMLSLQMLELITRLHQYIFSHILRLEKPALEFKPTDAD

SEQ ID NO: 5730 - protein, 40 aa, Artificial Sequence
  Description of Artificial Sequence: Synthetic polypeptide
MSLQMLELITRLHQYIFSHILRLEKPALEFKPTDADSAYC

SEQ ID NO: 5731 - protein, 40 aa, Artificial Sequence
  Description of Artificial Sequence: Synthetic polypeptide
LQMLELITRLHQYIFSHILRLEKPALEFKPTDADSAYCVL

SEQ ID NO: 5732 - protein, 40 aa, Artificial Sequence
  Description of Artificial Sequence: Synthetic polypeptide
QMLELITRLHQYIFSHILRLEKPALEFKPTDADSAYCVLP

SEQ ID NO: 5733 - protein, 40 aa, Artificial Sequence
  Description of Artificial Sequence: Synthetic polypeptide
ITRLHQYIFSHILRLEKPALEFKPTDADSAYCVLPLNVVN

SEQ ID NO: 5734 - protein, 40 aa, Artificial Sequence
  Description of Artificial Sequence: Synthetic polypeptide
QYIFSHILRLEKPALEFKPTDADSAYCVLPLNVVNDSSTL

SEQ ID NO: 5735 - protein, 40 aa, Artificial Sequence
  Description of Artificial Sequence: Synthetic polypeptide
YIFSHILRLEKPALEFKPTDADSAYCVLPLNVVNDSSTLD

SEQ ID NO: 5736 - protein, 40 aa, Artificial Sequence
  Description of Artificial Sequence: Synthetic polypeptide
LNVVNDSSTLDIDFKFMEDIEKSEARIGIPSTKYTKETPF

SEQ ID NO: 5737 - protein, 40 aa, Artificial Sequence
  Description of Artificial Sequence: Synthetic polypeptide
NVVNDSSTLDIDFKFMEDIEKSEARIGIPSTKYTKETPFV

SEQ ID NO: 5738 - protein, 40 aa, Artificial Sequence
  Description of Artificial Sequence: Synthetic polypeptide
VVNDSSTLDIDFKFMEDIEKSEARIGIPSTKYTKETPFVF

SEQ ID NO: 5739 - protein, 40 aa, Artificial Sequence
  Description of Artificial Sequence: Synthetic polypeptide
VNDSSTLDIDFKFMEDIEKSEARIGIPSTKYTKETPFVFK

SEQ ID NO: 5740 - protein, 40 aa, Artificial Sequence
  Description of Artificial Sequence: Synthetic polypeptide
NDSSTLDIDFKFMEDIEKSEARIGIPSTKYTKETPFVFKL

SEQ ID NO: 5741 - protein, 40 aa, Artificial Sequence
  Description of Artificial Sequence: Synthetic polypeptide
DSSTLDIDFKFMEDIEKSEARIGIPSTKYTKETPFVFKLE

SEQ ID NO: 5742 - protein, 40 aa, Artificial Sequence
  Description of Artificial Sequence: Synthetic polypeptide
SSTLDIDFKFMEDIEKSEARIGIPSTKYTKETPFVFKLED

SEQ ID NO: 5743 - protein, 40 aa, Artificial Sequence
  Description of Artificial Sequence: Synthetic polypeptide
TLDIDFKFMEDIEKSEARIGIPSTKYTKETPFVFKLEDYQ

SEQ ID NO: 5744 - protein, 40 aa, Artificial Sequence
  Description of Artificial Sequence: Synthetic polypeptide
MDIDFKFMEDIEKSEARIGIPSTKYTKETPFVFKLEDYQD

SEQ ID NO: 5745 - protein, 40 aa, Artificial Sequence
  Description of Artificial Sequence: Synthetic polypeptide
IDFKFMEDIEKSEARIGIPSTKYTKETPFVFKLEDYQDAV

SEQ ID NO: 5746 - protein, 40 aa, Artificial Sequence
  Description of Artificial Sequence: Synthetic polypeptide
FKFMEDIEKSEARIGIPSTKYTKETPFVFKLEDYQDAVII

SEQ ID NO: 5747 - protein, 40 aa, Artificial Sequence
  Description of Artificial Sequence: Synthetic polypeptide
FMEDIEKSEARIGIPSTKYTKETPFVFKLEDYQDAVIIPR

SEQ ID NO: 5748 - protein, 40 aa, Artificial Sequence
  Description of Artificial Sequence: Synthetic polypeptide
MEDIEKSEARIGIPSTKYTKETPFVFKLEDYQDAVIIPRY

SEQ ID NO: 5749 - protein, 40 aa, Artificial Sequence
  Description of Artificial Sequence: Synthetic polypeptide
EDIEKSEARIGIPSTKYTKETPFVFKLEDYQDAVIIPRYR

SEQ ID NO: 5750 - protein, 40 aa, Artificial Sequence
  Description of Artificial Sequence: Synthetic polypeptide
DIEKSEARIGIPSTKYTKETPFVFKLEDYQDAVIIPRYRN

SEQ ID NO: 5751 - protein, 40 aa, Artificial Sequence
  Description of Artificial Sequence: Synthetic polypeptide
IEKSEARIGIPSTKYTKETPFVFKLEDYQDAVIIPRYRNF

SEQ ID NO: 5752 - protein, 40 aa, Artificial Sequence
  Description of Artificial Sequence: Synthetic polypeptide
EKSEARIGIPSTKYTKETPFVFKLEDYQDAVIIPRYRNFD

SEQ ID NO: 5753 - protein, 40 aa, Artificial Sequence
  Description of Artificial Sequence: Synthetic polypeptide
KSEARIGIPSTKYTKETPFVFKLEDYQDAVIIPRYRNFDQ

SEQ ID NO: 5754 - protein, 40 aa, Artificial Sequence
  Description of Artificial Sequence: Synthetic polypeptide
FVFKLEDYQDAVIIPRYRNFDQPHRFYVADVYTDLTPLSK

SEQ ID NO: 5755 - protein, 40 aa, Artificial Sequence
  Description of Artificial Sequence: Synthetic polypeptide
PRYRNFDQPHRFYVADVYTDLTPLSKFPSPEYETFAEYYK

SEQ ID NO: 5756 - protein, 40 aa, Artificial Sequence
  Description of Artificial Sequence: Synthetic polypeptide
FDQPHRFYVADVYTDLTPLSKFPSPEYETFAEYYKTKYNL

SEQ ID NO: 5757 - protein, 40 aa, Artificial Sequence
  Description of Artificial Sequence: Synthetic polypeptide
RFYVADVYTDLTPLSKFPSPEYETFAEYYKTKYNLDLTNL

SEQ ID NO: 5758 - protein, 40 aa, Artificial Sequence
  Description of Artificial Sequence: Synthetic polypeptide
ADVYTDLTPLSKFPSPEYETFAEYYKTKYNLDLTNLNQPL

SEQ ID NO: 5759 - protein, 40 aa, Artificial Sequence
  Description of Artificial Sequence: Synthetic polypeptide
YETFAEYYKTKYNLDLTNLNQPLLDVDHTSSRLNLLTPRH

SEQ ID NO: 5760 - protein, 40 aa, Artificial Sequence
  Description of Artificial Sequence: Synthetic polypeptide
EYYKTKYNLDLTNLNQPLLDVDHTSSRLNLLTPRHLNQKG

SEQ ID NO: 5761 - protein, 40 aa, Artificial Sequence
  Description of Artificial Sequence: Synthetic polypeptide
YKTKYNLDLTNLNQPLLDVDHTSSRLNLLTPRHLNQKGKA

SEQ ID NO: 5762 - protein, 40 aa, Artificial Sequence
  Description of Artificial Sequence: Synthetic polypeptide
LNQPLLDVDHTSSRLNLLTPRHLNQKGKALPLSSAEKRKA

SEQ ID NO: 5763 - protein, 40 aa, Artificial Sequence
  Description of Artificial Sequence: Synthetic polypeptide
PLLDVDHTSSRLNLLTPRHLNQKGKALPLSSAEKRKAKWE

SEQ ID NO: 5764 - protein, 40 aa, Artificial Sequence
  Description of Artificial Sequence: Synthetic polypeptide
VDHTSSRLNLLTPRHLNQKGKALPLSSAEKRKAKWESLQN

SEQ ID NO: 5765 - protein, 40 aa, Artificial Sequence
  Description of Artificial Sequence: Synthetic polypeptide
DHTSSRLNLLTPRHLNQKGKALPLSSAEKRKAKWESLQNK

SEQ ID NO: 5766 - protein, 40 aa, Artificial Sequence
  Description of Artificial Sequence: Synthetic polypeptide
RLNLLTPRHLNQKGKALPLSSAEKRKAKWESLQNKQILVP

SEQ ID NO: 5767 - protein, 40 aa, Artificial Sequence
  Description of Artificial Sequence: Synthetic polypeptide
LLTPRHLNQKGKALPLSSAEKRKAKWESLQNKQILVPELC

SEQ ID NO: 5768 - protein, 40 aa, Artificial Sequence
  Description of Artificial Sequence: Synthetic polypeptide
CLLTAEELRAQTASDAGVGVRSLPADFRYPNLDFGWKKSI

SEQ ID NO: 5769 - protein, 40 aa, Artificial Sequence
  Description of Artificial Sequence: Synthetic polypeptide
LRAQTASDAGVGVRSLPADFRYPNLDFGWKKSIDSKSFIS

SEQ ID NO: 5770 - protein, 40 aa, Artificial Sequence
  Description of Artificial Sequence: Synthetic polypeptide
AQTASDAGVGVRSLPADFRYPNLDFGWKKSIDSKSFISIS

SEQ ID NO: 5771 - protein, 40 aa, Artificial Sequence
  Description of Artificial Sequence: Synthetic polypeptide
TASDAGVGVRSLPADFRYPNLDFGWKKSIDSKSFISISNS

SEQ ID NO: 5772 - protein, 40 aa, Artificial Sequence
  Description of Artificial Sequence: Synthetic polypeptide
SLPADFRYPNLDFGWKKSIDSKSFISISNSSSAENDNYCK

SEQ ID NO: 5773 - protein, 40 aa, Artificial Sequence
  Description of Artificial Sequence: Synthetic polypeptide
KSFISISNSSSAENDNYCKHSTIVPENAAHQGANRTSSLE

SEQ ID NO: 5774 - protein, 40 aa, Artificial Sequence
  Description of Artificial Sequence: Synthetic polypeptide
HSTIVPENAAHQGANRTSSLENHDQMSVNCRTLLSESPGK

SEQ ID NO: 5775 - protein, 40 aa, Artificial Sequence
  Description of Artificial Sequence: Synthetic polypeptide
ENAAHQGANRTSSLENHDQMSVNCRTLLSESPGKLHVEVS

SEQ ID NO: 5776 - protein, 40 aa, Artificial Sequence
  Description of Artificial Sequence: Synthetic polypeptide
AAHQGANRTSSLENHDQMSVNCRTLLSESPGKLHVEVSAD

SEQ ID NO: 5777 - protein, 40 aa, Artificial Sequence
  Description of Artificial Sequence: Synthetic polypeptide
HQGANRTSSLENHDQMSVNCRTLLSESPGKLHVEVSADLT

SEQ ID NO: 5778 - protein, 40 aa, Artificial Sequence
  Description of Artificial Sequence: Synthetic polypeptide
NRTSSLENHDQMSVNCRTLLSESPGKLHVEVSADLTAING

SEQ ID NO: 5779 - protein, 40 aa, Artificial Sequence
  Description of Artificial Sequence: Synthetic polypeptide
RTSSLENHDQMSVNCRTLLSESPGKLHVEVSADLTAINGL

SEQ ID NO: 5780 - protein, 40 aa, Artificial Sequence
  Description of Artificial Sequence: Synthetic polypeptide
SSLENHDQMSVNCRTLLSESPGKLHVEVSADLTAINGLSY

SEQ ID NO: 5781 - protein, 40 aa, Artificial Sequence
  Description of Artificial Sequence: Synthetic polypeptide
SLENHDQMSVNCRTLLSESPGKLHVEVSADLTAINGLSYN

SEQ ID NO: 5782 - protein, 40 aa, Artificial Sequence
  Description of Artificial Sequence: Synthetic polypeptide
LENHDQMSVNCRTLLSESPGKLHVEVSADLTAINGLSYNQ

SEQ ID NO: 5783 - protein, 40 aa, Artificial Sequence
  Description of Artificial Sequence: Synthetic polypeptide
ENHDQMSVNCRTLLSESPGKLHVEVSADLTAINGLSYNQN

SEQ ID NO: 5784 - protein, 40 aa, Artificial Sequence
  Description of Artificial Sequence: Synthetic polypeptide
HDQMSVNCRTLLSESPGKLHVEVSADLTAINGLSYNQNLA

SEQ ID NO: 5785 - protein, 40 aa, Artificial Sequence
  Description of Artificial Sequence: Synthetic polypeptide
QMSVNCRTLLSESPGKLHVEVSADLTAINGLSYNQNLANG

SEQ ID NO: 5786 - protein, 40 aa, Artificial Sequence
  Description of Artificial Sequence: Synthetic polypeptide
SVNCRTLLSESPGKLHVEVSADLTAINGLSYNQNLANGSY

SEQ ID NO: 5787 - protein, 40 aa, Artificial Sequence
  Description of Artificial Sequence: Synthetic polypeptide
VNCRTLLSESPGKLHVEVSADLTAINGLSYNQNLANGSYD

SEQ ID NO: 5788 - protein, 40 aa, Artificial Sequence
  Description of Artificial Sequence: Synthetic polypeptide
NCRTLLSESPGKLHVEVSADLTAINGLSYNQNLANGSYDL

SEQ ID NO: 5789 - protein, 40 aa, Artificial Sequence
  Description of Artificial Sequence: Synthetic polypeptide
CRTLLSESPGKLHVEVSADLTAINGLSYNQNLANGSYDLA

SEQ ID NO: 5790 - protein, 40 aa, Artificial Sequence
  Description of Artificial Sequence: Synthetic polypeptide
RTLLSESPGKLHVEVSADLTAINGLSYNQNLANGSYDLAN

SEQ ID NO: 5791 - protein, 40 aa, Artificial Sequence
  Description of Artificial Sequence: Synthetic polypeptide
PGKLHVEVSADLTAINGLSYNQNLANGSYDLANRDFCQGN

SEQ ID NO: 5792 - protein, 40 aa, Artificial Sequence
  Description of Artificial Sequence: Synthetic polypeptide
YDLANRDFCQGNQLNYYKQEIPVQPTTSYSIQNLYSYENQ

SEQ ID NO: 5793 - protein, 40 aa, Artificial Sequence
  Description of Artificial Sequence: Synthetic polypeptide
LANRDFCQGNQLNYYKQEIPVQPTTSYSIQNLYSYENQPQ

SEQ ID NO: 5794 - protein, 40 aa, Artificial Sequence
  Description of Artificial Sequence: Synthetic polypeptide
PTTSYSIQNLYSYENQPQPSDECTLLSNKYLDGNANKSTS

SEQ ID NO: 5795 - protein, 40 aa, Artificial Sequence
  Description of Artificial Sequence: Synthetic polypeptide
ECTLLSNKYLDGNANKSTSDGSPVMAVMPGTTDTIQVLKG

SEQ ID NO: 5796 - protein, 40 aa, Artificial Sequence
  Description of Artificial Sequence: Synthetic polypeptide
CTLLSNKYLDGNANKSTSDGSPVMAVMPGTTDTIQVLKGR

SEQ ID NO: 5797 - protein, 40 aa, Artificial Sequence
  Description of Artificial Sequence: Synthetic polypeptide
LLSNKYLDGNANKSTSDGSPVMAVMPGTTDTIQVLKGRMD

SEQ ID NO: 5798 - protein, 40 aa, Artificial Sequence
  Description of Artificial Sequence: Synthetic polypeptide
DGFNLERLEMLGDSFLKHAITTYLFCTYPDAHEGRLSYMR

SEQ ID NO: 5799 - protein, 40 aa, Artificial Sequence
  Description of Artificial Sequence: Synthetic polypeptide
LEMLGDSFLKHAITTYLFCTYPDAHEGRLSYMRSKKVSNC

SEQ ID NO: 5800 - protein, 40 aa, Artificial Sequence
  Description of Artificial Sequence: Synthetic polypeptide
MLGDSFLKHAITTYLFCTYPDAHEGRLSYMRSKKVSNCNL

SEQ ID NO: 5801 - protein, 40 aa, Artificial Sequence
  Description of Artificial Sequence: Synthetic polypeptide
LKHAITTYLFCTYPDAHEGRLSYMRSKKVSNCNLYRLGKK

SEQ ID NO: 5802 - protein, 40 aa, Artificial Sequence
  Description of Artificial Sequence: Synthetic polypeptide
KHAITTYLFCTYPDAHEGRLSYMRSKKVSNCNLYRLGKKK

SEQ ID NO: 5803 - protein, 40 aa, Artificial Sequence
  Description of Artificial Sequence: Synthetic polypeptide
HAITTYLFCTYPDAHEGRLSYMRSKKVSNCNLYRLGKKKG

SEQ ID NO: 5804 - protein, 40 aa, Artificial Sequence
  Description of Artificial Sequence: Synthetic polypeptide
ITTYLFCTYPDAHEGRLSYMRSKKVSNCNLYRLGKKKGLP

SEQ ID NO: 5805 - protein, 40 aa, Artificial Sequence
  Description of Artificial Sequence: Synthetic polypeptide
YLFCTYPDAHEGRLSYMRSKKVSNCNLYRLGKKKGLPSRM

SEQ ID NO: 5806 - protein, 40 aa, Artificial Sequence
  Description of Artificial Sequence: Synthetic polypeptide
LFCTYPDAHEGRLSYMRSKKVSNCNLYRLGKKKGLPSRMV

SEQ ID NO: 5807 - protein, 40 aa, Artificial Sequence
  Description of Artificial Sequence: Synthetic polypeptide
TYPDAHEGRLSYMRSKKVSNCNLYRLGKKKGLPSRMVVSI

SEQ ID NO: 5808 - protein, 40 aa, Artificial Sequence
  Description of Artificial Sequence: Synthetic polypeptide
YPDAHEGRLSYMRSKKVSNCNLYRLGKKKGLPSRMVVSIF

SEQ ID NO: 5809 - protein, 40 aa, Artificial Sequence
  Description of Artificial Sequence: Synthetic polypeptide
PDAHEGRLSYMRSKKVSNCNLYRLGKKKGLPSRMVVSIFD

SEQ ID NO: 5810 - protein, 40 aa, Artificial Sequence
  Description of Artificial Sequence: Synthetic polypeptide
AHEGRLSYMRSKKVSNCNLYRLGKKKGLPSRMVVSIFDPP

SEQ ID NO: 5811 - protein, 40 aa, Artificial Sequence
  Description of Artificial Sequence: Synthetic polypeptide
GRLSYMRSKKVSNCNLYRLGKKKGLPSRMVVSIFDPPVNW

SEQ ID NO: 5812 - protein, 40 aa, Artificial Sequence
  Description of Artificial Sequence: Synthetic polypeptide
RLSYMRSKKVSNCNLYRLGKKKGLPSRMVVSIFDPPVNWL

SEQ ID NO: 5813 - protein, 40 aa, Artificial Sequence
  Description of Artificial Sequence: Synthetic polypeptide
LSYMRSKKVSNCNLYRLGKKKGLPSRMVVSIFDPPVNWLP

SEQ ID NO: 5814 - protein, 40 aa, Artificial Sequence
  Description of Artificial Sequence: Synthetic polypeptide
KKVSNCNLYRLGKKKGLPSRMVVSIFDPPVNWLPPGYVVN

SEQ ID NO: 5815 - protein, 40 aa, Artificial Sequence
  Description of Artificial Sequence: Synthetic polypeptide
GLPSRMVVSIFDPPVNWLPPGYVVNQDKSNTDKWEKDEMT

SEQ ID NO: 5816 - protein, 40 aa, Artificial Sequence
  Description of Artificial Sequence: Synthetic polypeptide
DKSNTDKWEKDEMTKDCMLANGKLDEDYEEEDEEEESLMW

SEQ ID NO: 5817 - protein, 40 aa, Artificial Sequence
  Description of Artificial Sequence: Synthetic polypeptide
SLMWRAPKEEADYEDDFLEYDQEHIRFIDNMLMGSGAFVK

SEQ ID NO: 5818 - protein, 40 aa, Artificial Sequence
  Description of Artificial Sequence: Synthetic polypeptide
RAPKEEADYEDDFLEYDQEHIRFIDNMLMGSGAFVKKISL

SEQ ID NO: 5819 - protein, 40 aa, Artificial Sequence
  Description of Artificial Sequence: Synthetic polypeptide
KEEADYEDDFLEYDQEHIRFIDNMLMGSGAFVKKISLSPF

SEQ ID NO: 5820 - protein, 40 aa, Artificial Sequence
  Description of Artificial Sequence: Synthetic polypeptide
EADYEDDFLEYDQEHIRFIDNMLMGSGAFVKKISLSPFST

SEQ ID NO: 5821 - protein, 40 aa, Artificial Sequence
  Description of Artificial Sequence: Synthetic polypeptide
ADYEDDFLEYDQEHIRFIDNMLMGSGAFVKKISLSPFSTT

SEQ ID NO: 5822 - protein, 40 aa, Artificial Sequence
  Description of Artificial Sequence: Synthetic polypeptide
YEDDFLEYDQEHIRFIDNMLMGSGAFVKKISLSPFSTTDS

SEQ ID NO: 5823 - protein, 40 aa, Artificial Sequence
  Description of Artificial Sequence: Synthetic polypeptide
DDFLEYDQEHIRFIDNMLMGSGAFVKKISLSPFSTTDSAY

SEQ ID NO: 5824 - protein, 40 aa, Artificial Sequence
  Description of Artificial Sequence: Synthetic polypeptide
DFLEYDQEHIRFIDNMLMGSGAFVKKISLSPFSTTDSAYE

SEQ ID NO: 5825 - protein, 40 aa, Artificial Sequence
  Description of Artificial Sequence: Synthetic polypeptide
FLEYDQEHIRFIDNMLMGSGAFVKKISLSPFSTTDSAYEW

SEQ ID NO: 5826 - protein, 40 aa, Artificial Sequence
  Description of Artificial Sequence: Synthetic polypeptide
EYDQEHIRFIDNMLMGSGAFVKKISLSPFSTTDSAYEWKM

SEQ ID NO: 5827 - protein, 40 aa, Artificial Sequence
  Description of Artificial Sequence: Synthetic polypeptide
YDQEHIRFIDNMLMGSGAFVKKISLSPFSTTDSAYEWKMP

SEQ ID NO: 5828 - protein, 40 aa, Artificial Sequence
  Description of Artificial Sequence: Synthetic polypeptide
QEHIRFIDNMLMGSGAFVKKISLSPFSTTDSAYEWKMPKK

SEQ ID NO: 5829 - protein, 40 aa, Artificial Sequence
  Description of Artificial Sequence: Synthetic polypeptide
EHIRFIDNMLMGSGAFVKKISLSPFSTTDSAYEWKMPKKS

SEQ ID NO: 5830 - protein, 40 aa, Artificial Sequence
  Description of Artificial Sequence: Synthetic polypeptide
HIRFIDNMLMGSGAFVKKISLSPFSTTDSAYEWKMPKKSS

SEQ ID NO: 5831 - protein, 40 aa, Artificial Sequence
  Description of Artificial Sequence: Synthetic polypeptide
FIDNMLMGSGAFVKKISLSPFSTTDSAYEWKMPKKSSLGS

SEQ ID NO: 5832 - protein, 40 aa, Artificial Sequence
  Description of Artificial Sequence: Synthetic polypeptide
IDNMLMGSGAFVKKISLSPFSTTDSAYEWKMPKKSSLGSM

SEQ ID NO: 5833 - protein, 40 aa, Artificial Sequence
  Description of Artificial Sequence: Synthetic polypeptide
DNMLMGSGAFVKKISLSPFSTTDSAYEWKMPKKSSLGSMP

SEQ ID NO: 5834 - protein, 40 aa, Artificial Sequence
  Description of Artificial Sequence: Synthetic polypeptide
NMLMGSGAFVKKISLSPFSTTDSAYEWKMPKKSSLGSMPF

SEQ ID NO: 5835 - protein, 40 aa, Artificial Sequence
  Description of Artificial Sequence: Synthetic polypeptide
LMGSGAFVKKISLSPFSTTDSAYEWKMPKKSSLGSMPFSS

SEQ ID NO: 5836 - protein, 40 aa, Artificial Sequence
  Description of Artificial Sequence: Synthetic polypeptide
GSGAFVKKISLSPFSTTDSAYEWKMPKKSSLGSMPFSSDF

SEQ ID NO: 5837 - protein, 40 aa, Artificial Sequence
  Description of Artificial Sequence: Synthetic polypeptide
AFVKKISLSPFSTTDSAYEWKMPKKSSLGSMPFSSDFEDF

SEQ ID NO: 5838 - protein, 40 aa, Artificial Sequence
  Description of Artificial Sequence: Synthetic polypeptide
VKKISLSPFSTTDSAYEWKMPKKSSLGSMPFSSDFEDFDY

SEQ ID NO: 5839 - protein, 40 aa, Artificial Sequence
  Description of Artificial Sequence: Synthetic polypeptide
CGVDTGKQSISYDLHTEQCIADKSIADCVEALLGCYLTSC

SEQ ID NO: 5840 - protein, 40 aa, Artificial Sequence
  Description of Artificial Sequence: Synthetic polypeptide
SYDLHTEQCIADKSIADCVEALLGCYLTSCGERAAQLFLC

SEQ ID NO: 5841 - protein, 40 aa, Artificial Sequence
  Description of Artificial Sequence: Synthetic polypeptide
KSIADCVEALLGCYLTSCGERAAQLFLCSLGLKVLPVIKR

SEQ ID NO: 5842 - protein, 40 aa, Artificial Sequence
  Description of Artificial Sequence: Synthetic polypeptide
CVEALLGCYLTSCGERAAQLFLCSLGLKVLPVIKRTDREK

SEQ ID NO: 5843 - protein, 40 aa, Artificial Sequence
  Description of Artificial Sequence: Synthetic polypeptide
GCYLTSCGERAAQLFLCSLGLKVLPVIKRTDREKALCPTR

SEQ ID NO: 5844 - protein, 40 aa, Artificial Sequence
  Description of Artificial Sequence: Synthetic polypeptide
VLKDSEYGCLKIPPRCMFDHPDADKTLNHLISGFENFEKK

SEQ ID NO: 5845 - protein, 40 aa, Artificial Sequence
  Description of Artificial Sequence: Synthetic polypeptide
MKIPPRCMFDHPDADKTLNHLISGFENFEKKINYRFKNKA

SEQ ID NO: 5846 - protein, 40 aa, Artificial Sequence
  Description of Artificial Sequence: Synthetic polypeptide
KIPPRCMFDHPDADKTLNHLISGFENFEKKINYRFKNKAY

SEQ ID NO: 5847 - protein, 40 aa, Artificial Sequence
  Description of Artificial Sequence: Synthetic polypeptide
PPRCMFDHPDADKTLNHLISGFENFEKKINYRFKNKAYLL

SEQ ID NO: 5848 - protein, 40 aa, Artificial Sequence
  Description of Artificial Sequence: Synthetic polypeptide
MFDHPDADKTLNHLISGFENFEKKINYRFKNKAYLLQAFT

SEQ ID NO: 5849 - protein, 40 aa, Artificial Sequence
  Description of Artificial Sequence: Synthetic polypeptide
PDADKTLNHLISGFENFEKKINYRFKNKAYLLQAFTHASY

SEQ ID NO: 5850 - protein, 40 aa, Artificial Sequence
  Description of Artificial Sequence: Synthetic polypeptide
DKTLNHLISGFENFEKKINYRFKNKAYLLQAFTHASYHYN

SEQ ID NO: 5851 - protein, 40 aa, Artificial Sequence
  Description of Artificial Sequence: Synthetic polypeptide
GFENFEKKINYRFKNKAYLLQAFTHASYHYNTITDCYQRL

SEQ ID NO: 5852 - protein, 40 aa, Artificial Sequence
  Description of Artificial Sequence: Synthetic polypeptide
YLLQAFTHASYHYNTITDCYQRLEFLGDAILDYLITKHLY

SEQ ID NO: 5853 - protein, 40 aa, Artificial Sequence
  Description of Artificial Sequence: Synthetic polypeptide
YLITKHLYEDPRQHSPGVLTDLRSALVNNTIFASLAVKYD

SEQ ID NO: 5854 - protein, 40 aa, Artificial Sequence
  Description of Artificial Sequence: Synthetic polypeptide
SPGVLTDLRSALVNNTIFASLAVKYDYHKYFKAVSPELFH

SEQ ID NO: 5855 - protein, 40 aa, Artificial Sequence
  Description of Artificial Sequence: Synthetic polypeptide
AMGDIFESLAGAIYMDSGMSLETVWQVYYPMMRPLIEKFS

SEQ ID NO: 5856 - protein, 40 aa, Artificial Sequence
  Description of Artificial Sequence: Synthetic polypeptide
MGDIFESLAGAIYMDSGMSLETVWQVYYPMMRPLIEKFSA

SEQ ID NO: 5857 - protein, 40 aa, Artificial Sequence
  Description of Artificial Sequence: Synthetic polypeptide
GDIFESLAGAIYMDSGMSLETVWQVYYPMMRPLIEKFSAN

SEQ ID NO: 5858 - protein, 40 aa, Artificial Sequence
  Description of Artificial Sequence: Synthetic polypeptide
FESLAGAIYMDSGMSLETVWQVYYPMMRPLIEKFSANVPR

SEQ ID NO: 5859 - protein, 40 aa, Artificial Sequence
  Description of Artificial Sequence: Synthetic polypeptide
PVRELLEMEPETAKFSPAERTYDGKVRVTVEVVGKGKFKG

SEQ ID NO: 5860 - protein, 40 aa, Artificial Sequence
  Description of Artificial Sequence: Synthetic polypeptide
MEPETAKFSPAERTYDGKVRVTVEVVGKGKFKGVGRSYRI

SEQ ID NO: 5861 - protein, 40 aa, Artificial Sequence
  Description of Artificial Sequence: Synthetic polypeptide
TAKFSPAERTYDGKVRVTVEVVGKGKFKGVGRSYRIAKSA

SEQ ID NO: 5862 - protein, 40 aa, Artificial Sequence
  Description of Artificial Sequence: Synthetic polypeptide
FSPAERTYDGKVRVTVEVVGKGKFKGVGRSYRIAKSAAAR

SEQ ID NO: 5863 - protein, 40 aa, Artificial Sequence
  Description of Artificial Sequence: Synthetic polypeptide
PAERTYDGKVRVTVEVVGKGKFKGVGRSYRIAKSAAARRA

SEQ ID NO: 5864 - protein, 40 aa, Artificial Sequence
  Description of Artificial Sequence: Synthetic polypeptide
TAGAALLALLAALCPASRALEEKKVCQGTSNKLTQLGTFE

SEQ ID NO: 5865 - protein, 40 aa, Artificial Sequence
  Description of Artificial Sequence: Synthetic polypeptide
MGTFEDHFLSLQRMFNNCEVVLGNLEITYVQRNYDLSFLK

SEQ ID NO: 5866 - protein, 40 aa, Artificial Sequence
  Description of Artificial Sequence: Synthetic polypeptide
DHFLSLQRMFNNCEVVLGNLEITYVQRNYDLSFLKTIQEV

SEQ ID NO: 5867 - protein, 40 aa, Artificial Sequence
  Description of Artificial Sequence: Synthetic polypeptide
LQRMFNNCEVVLGNLEITYVQRNYDLSFLKTIQEVAGYVL

SEQ ID NO: 5868 - protein, 40 aa, Artificial Sequence
  Description of Artificial Sequence: Synthetic polypeptide
ALNTVERIPLENLQIIRGNMYYENSYALAVLSNYDANKTG

SEQ ID NO: 5869 - protein, 40 aa, Artificial Sequence
  Description of Artificial Sequence: Synthetic polypeptide
MENLQIIRGNMYYENSYALAVLSNYDANKTGLKELPMRNL

SEQ ID NO: 5870 - protein, 40 aa, Artificial Sequence
  Description of Artificial Sequence: Synthetic polypeptide
ENLQIIRGNMYYENSYALAVLSNYDANKTGLKELPMRNLQ

SEQ ID NO: 5871 - protein, 40 aa, Artificial Sequence
  Description of Artificial Sequence: Synthetic polypeptide
VKKCPRNYVVTDHGSCVRACGADSYEMEEDGVRKCKKCEG

SEQ ID NO: 5872 - protein, 40 aa, Artificial Sequence
  Description of Artificial Sequence: Synthetic polypeptide
ACGADSYEMEEDGVRKCKKCEGPCRKVCNGIGIGEFKDSL

SEQ ID NO: 5873 - protein, 40 aa, Artificial Sequence
  Description of Artificial Sequence: Synthetic polypeptide
SYEMEEDGVRKCKKCEGPCRKVCNGIGIGEFKDSLSINAT

SEQ ID NO: 5874 - protein, 40 aa, Artificial Sequence
  Description of Artificial Sequence: Synthetic polypeptide
YEMEEDGVRKCKKCEGPCRKVCNGIGIGEFKDSLSINATN

SEQ ID NO: 5875 - protein, 40 aa, Artificial Sequence
  Description of Artificial Sequence: Synthetic polypeptide
EDGVRKCKKCEGPCRKVCNGIGIGEFKDSLSINATNIKHF

SEQ ID NO: 5876 - protein, 40 aa, Artificial Sequence
  Description of Artificial Sequence: Synthetic polypeptide
EGPCRKVCNGIGIGEFKDSLSINATNIKHFKNCTSISGDL

SEQ ID NO: 5877 - protein, 40 aa, Artificial Sequence
  Description of Artificial Sequence: Synthetic polypeptide
KNCTSISGDLHILPVAFRGDSFTHTPPLDPQELDILKTVK

SEQ ID NO: 5878 - protein, 40 aa, Artificial Sequence
  Description of Artificial Sequence: Synthetic polypeptide
SISGDLHILPVAFRGDSFTHTPPLDPQELDILKTVKEITG

SEQ ID NO: 5879 - protein, 40 aa, Artificial Sequence
  Description of Artificial Sequence: Synthetic polypeptide
SGDLHILPVAFRGDSFTHTPPLDPQELDILKTVKEITGFL

SEQ ID NO: 5880 - protein, 40 aa, Artificial Sequence
  Description of Artificial Sequence: Synthetic polypeptide
DLHILPVAFRGDSFTHTPPLDPQELDILKTVKEITGFLLI

SEQ ID NO: 5881 - protein, 40 aa, Artificial Sequence
  Description of Artificial Sequence: Synthetic polypeptide
ILPVAFRGDSFTHTPPLDPQELDILKTVKEITGFLLIQAW

SEQ ID NO: 5882 - protein, 40 aa, Artificial Sequence
  Description of Artificial Sequence: Synthetic polypeptide
MPVAFRGDSFTHTPPLDPQELDILKTVKEITGFLLIQAWP

SEQ ID NO: 5883 - protein, 40 aa, Artificial Sequence
  Description of Artificial Sequence: Synthetic polypeptide
TPPLDPQELDILKTVKEITGFLLIQAWPENRTDLHAFENL

SEQ ID NO: 5884 - protein, 40 aa, Artificial Sequence
  Description of Artificial Sequence: Synthetic polypeptide
QELDILKTVKEITGFLLIQAWPENRTDLHAFENLEIIRGR

SEQ ID NO: 5885 - protein, 40 aa, Artificial Sequence
  Description of Artificial Sequence: Synthetic polypeptide
DILKTVKEITGFLLIQAWPENRTDLHAFENLEIIRGRTKQ

SEQ ID NO: 5886 - protein, 40 aa, Artificial Sequence
  Description of Artificial Sequence: Synthetic polypeptide
VKEITGFLLIQAWPENRTDLHAFENLEIIRGRTKQHGQFS

SEQ ID NO: 5887 - protein, 40 aa, Artificial Sequence
  Description of Artificial Sequence: Synthetic polypeptide
LEIIRGRTKQHGQFSLAVVSLNITSLGLRSLKEISDGDVI

SEQ ID NO: 5888 - protein, 40 aa, Artificial Sequence
  Description of Artificial Sequence: Synthetic polypeptide
RGRTKQHGQFSLAVVSLNITSLGLRSLKEISDGDVIISGN

SEQ ID NO: 5889 - protein, 40 aa, Artificial Sequence
  Description of Artificial Sequence: Synthetic polypeptide
HGQFSLAVVSLNITSLGLRSLKEISDGDVIISGNKNLCYA

SEQ ID NO: 5890 - protein, 40 aa, Artificial Sequence
  Description of Artificial Sequence: Synthetic polypeptide
FSLAVVSLNITSLGLRSLKEISDGDVIISGNKNLCYANTI

SEQ ID NO: 5891 - protein, 40 aa, Artificial Sequence
  Description of Artificial Sequence: Synthetic polypeptide
VVSLNITSLGLRSLKEISDGDVIISGNKNLCYANTINWKK

SEQ ID NO: 5892 - protein, 40 aa, Artificial Sequence
  Description of Artificial Sequence: Synthetic polypeptide
NITSLGLRSLKEISDGDVIISGNKNLCYANTINWKKLFGT

SEQ ID NO: 5893 - protein, 40 aa, Artificial Sequence
  Description of Artificial Sequence: Synthetic polypeptide
ITSLGLRSLKEISDGDVIISGNKNLCYANTINWKKLFGTS

SEQ ID NO: 5894 - protein, 40 aa, Artificial Sequence
  Description of Artificial Sequence: Synthetic polypeptide
TSLGLRSLKEISDGDVIISGNKNLCYANTINWKKLFGTSG

SEQ ID NO: 5895 - protein, 40 aa, Artificial Sequence
  Description of Artificial Sequence: Synthetic polypeptide
SLGLRSLKEISDGDVIISGNKNLCYANTINWKKLFGTSGQ

SEQ ID NO: 5896 - protein, 40 aa, Artificial Sequence
  Description of Artificial Sequence: Synthetic polypeptide
GLRSLKEISDGDVIISGNKNLCYANTINWKKLFGTSGQKT

SEQ ID NO: 5897 - protein, 40 aa, Artificial Sequence
  Description of Artificial Sequence: Synthetic polypeptide
RSLKEISDGDVIISGNKNLCYANTINWKKLFGTSGQKTKI

SEQ ID NO: 5898 - protein, 40 aa, Artificial Sequence
  Description of Artificial Sequence: Synthetic polypeptide
MCYANTINWKKLFGTSGQKTKIISNRGENSCKATGQVCHA

SEQ ID NO: 5899 - protein, 40 aa, Artificial Sequence
  Description of Artificial Sequence: Synthetic polypeptide
CYANTINWKKLFGTSGQKTKIISNRGENSCKATGQVCHAL

SEQ ID NO: 5900 - protein, 40 aa, Artificial Sequence
  Description of Artificial Sequence: Synthetic polypeptide
TINWKKLFGTSGQKTKIISNRGENSCKATGQVCHALCSPE

SEQ ID NO: 5901 - protein, 40 aa, Artificial Sequence
  Description of Artificial Sequence: Synthetic polypeptide
INWKKLFGTSGQKTKIISNRGENSCKATGQVCHALCSPEG

SEQ ID NO: 5902 - protein, 40 aa, Artificial Sequence
  Description of Artificial Sequence: Synthetic polypeptide
WKKLFGTSGQKTKIISNRGENSCKATGQVCHALCSPEGCW

SEQ ID NO: 5903 - protein, 40 aa, Artificial Sequence
  Description of Artificial Sequence: Synthetic polypeptide
GTSGQKTKIISNRGENSCKATGQVCHALCSPEGCWGPEPR

SEQ ID NO: 5904 - protein, 40 aa, Artificial Sequence
  Description of Artificial Sequence: Synthetic polypeptide
RGENSCKATGQVCHALCSPEGCWGPEPRDCVSCRNVSRGR

SEQ ID NO: 5905 - protein, 40 aa, Artificial Sequence
  Description of Artificial Sequence: Synthetic polypeptide
LFMRRRHIVRKRTLRRLLQERELVEPLTPSGEAPNQALLR

SEQ ID NO: 5906 - protein, 40 aa, Artificial Sequence
  Description of Artificial Sequence: Synthetic polypeptide
MRRLLQERELVEPLTPSGEAPNQALLRILKETEFKKIKVL

SEQ ID NO: 5907 - protein, 40 aa, Artificial Sequence
  Description of Artificial Sequence: Synthetic polypeptide
RRLLQERELVEPLTPSGEAPNQALLRILKETEFKKIKVLG

SEQ ID NO: 5908 - protein, 40 aa, Artificial Sequence
  Description of Artificial Sequence: Synthetic polypeptide
QERELVEPLTPSGEAPNQALLRILKETEFKKIKVLGSGAF

SEQ ID NO: 5909 - protein, 40 aa, Artificial Sequence
  Description of Artificial Sequence: Synthetic polypeptide
LVEPLTPSGEAPNQALLRILKETEFKKIKVLGSGAFGTVY

SEQ ID NO: 5910 - protein, 40 aa, Artificial Sequence
  Description of Artificial Sequence: Synthetic polypeptide
PLTPSGEAPNQALLRILKETEFKKIKVLGSGAFGTVYKGL

SEQ ID NO: 5911 - protein, 40 aa, Artificial Sequence
  Description of Artificial Sequence: Synthetic polypeptide
SGEAPNQALLRILKETEFKKIKVLGSGAFGTVYKGLWIPE

SEQ ID NO: 5912 - protein, 40 aa, Artificial Sequence
  Description of Artificial Sequence: Synthetic polypeptide
ALLRILKETEFKKIKVLGSGAFGTVYKGLWIPEGEKVKIP

SEQ ID NO: 5913 - protein, 40 aa, Artificial Sequence
  Description of Artificial Sequence: Synthetic polypeptide
LLRILKETEFKKIKVLGSGAFGTVYKGLWIPEGEKVKIPV

SEQ ID NO: 5914 - protein, 40 aa, Artificial Sequence
  Description of Artificial Sequence: Synthetic polypeptide
MRILKETEFKKIKVLGSGAFGTVYKGLWIPEGEKVKIPVA

SEQ ID NO: 5915 - protein, 40 aa, Artificial Sequence
  Description of Artificial Sequence: Synthetic polypeptide
ILKETEFKKIKVLGSGAFGTVYKGLWIPEGEKVKIPVAIK

SEQ ID NO: 5916 - protein, 40 aa, Artificial Sequence
  Description of Artificial Sequence: Synthetic polypeptide
TEFKKIKVLGSGAFGTVYKGLWIPEGEKVKIPVAIKELRE

SEQ ID NO: 5917 - protein, 40 aa, Artificial Sequence
  Description of Artificial Sequence: Synthetic polypeptide
FKKIKVLGSGAFGTVYKGLWIPEGEKVKIPVAIKELREAT

SEQ ID NO: 5918 - protein, 40 aa, Artificial Sequence
  Description of Artificial Sequence: Synthetic polypeptide
KKIKVLGSGAFGTVYKGLWIPEGEKVKIPVAIKELREATS

SEQ ID NO: 5919 - protein, 40 aa, Artificial Sequence
  Description of Artificial Sequence: Synthetic polypeptide
KIKVLGSGAFGTVYKGLWIPEGEKVKIPVAIKELREATSP

SEQ ID NO: 5920 - protein, 40 aa, Artificial Sequence
  Description of Artificial Sequence: Synthetic polypeptide
IKVLGSGAFGTVYKGLWIPEGEKVKIPVAIKELREATSPK

SEQ ID NO: 5921 - protein, 40 aa, Artificial Sequence
  Description of Artificial Sequence: Synthetic polypeptide
GAFGTVYKGLWIPEGEKVKIPVAIKELREATSPKANKEIL

SEQ ID NO: 5922 - protein, 40 aa, Artificial Sequence
  Description of Artificial Sequence: Synthetic polypeptide
AFGTVYKGLWIPEGEKVKIPVAIKELREATSPKANKEILD

SEQ ID NO: 5923 - protein, 40 aa, Artificial Sequence
  Description of Artificial Sequence: Synthetic polypeptide
TVYKGLWIPEGEKVKIPVAIKELREATSPKANKEILDEAY

SEQ ID NO: 5924 - protein, 40 aa, Artificial Sequence
  Description of Artificial Sequence: Synthetic polypeptide
VYKGLWIPEGEKVKIPVAIKELREATSPKANKEILDEAYV

SEQ ID NO: 5925 - protein, 40 aa, Artificial Sequence
  Description of Artificial Sequence: Synthetic polypeptide
YKGLWIPEGEKVKIPVAIKELREATSPKANKEILDEAYVM

SEQ ID NO: 5926 - protein, 40 aa, Artificial Sequence
  Description of Artificial Sequence: Synthetic polypeptide
GLWIPEGEKVKIPVAIKELREATSPKANKEILDEAYVMAS

SEQ ID NO: 5927 - protein, 40 aa, Artificial Sequence
  Description of Artificial Sequence: Synthetic polypeptide
SSILEKGERLPQPPICTIDVYMIMVKCWMIDADSRPKFRE

SEQ ID NO: 5928 - protein, 40 aa, Artificial Sequence
  Description of Artificial Sequence: Synthetic polypeptide
ERLPQPPICTIDVYMIMVKCWMIDADSRPKFRELIIEFSK

SEQ ID NO: 5929 - protein, 40 aa, Artificial Sequence
  Description of Artificial Sequence: Synthetic polypeptide
NGLQSCPIKEDSFLQRYSSDPTGALTEDSIDDTFLPVPEY

SEQ ID NO: 5930 - protein, 40 aa, Artificial Sequence
  Description of Artificial Sequence: Synthetic polypeptide
KEDSFLQRYSSDPTGALTEDSIDDTFLPVPEYINQSVPKR

SEQ ID NO: 5931 - protein, 40 aa, Artificial Sequence
  Description of Artificial Sequence: Synthetic polypeptide
EDSFLQRYSSDPTGALTEDSIDDTFLPVPEYINQSVPKRP

SEQ ID NO: 5932 - protein, 40 aa, Artificial Sequence
  Description of Artificial Sequence: Synthetic polypeptide
FLQRYSSDPTGALTEDSIDDTFLPVPEYINQSVPKRPAGS

SEQ ID NO: 5933 - protein, 40 aa, Artificial Sequence
  Description of Artificial Sequence: Synthetic polypeptide
SDPTGALTEDSIDDTFLPVPEYINQSVPKRPAGSVQNPVY

SEQ ID NO: 5934 - protein, 40 aa, Artificial Sequence
  Description of Artificial Sequence: Synthetic polypeptide
PTGALTEDSIDDTFLPVPEYINQSVPKRPAGSVQNPVYHN

SEQ ID NO: 5935 - protein, 40 aa, Artificial Sequence
  Description of Artificial Sequence: Synthetic polypeptide
NLELTYLPTNASLSFLQDIQEVQGYVLIAHNQVRQVPLQR

SEQ ID NO: 5936 - protein, 40 aa, Artificial Sequence
  Description of Artificial Sequence: Synthetic polypeptide
TNASLSFLQDIQEVQGYVLIAHNQVRQVPLQRLRIVRGTQ

SEQ ID NO: 5937 - protein, 40 aa, Artificial Sequence
  Description of Artificial Sequence: Synthetic polypeptide
RGTQLFEDNYALAVLDNGDPLNNTTPVTGASPGGLRELQL

SEQ ID NO: 5938 - protein, 40 aa, Artificial Sequence
  Description of Artificial Sequence: Synthetic polypeptide
GTQLFEDNYALAVLDNGDPLNNTTPVTGASPGGLRELQLR

SEQ ID NO: 5939 - protein, 40 aa, Artificial Sequence
  Description of Artificial Sequence: Synthetic polypeptide
LFEDNYALAVLDNGDPLNNTTPVTGASPGGLRELQLRSLT

SEQ ID NO: 5940 - protein, 40 aa, Artificial Sequence
  Description of Artificial Sequence: Synthetic polypeptide
FEDNYALAVLDNGDPLNNTTPVTGASPGGLRELQLRSLTE

SEQ ID NO: 5941 - protein, 40 aa, Artificial Sequence
  Description of Artificial Sequence: Synthetic polypeptide
EDNYALAVLDNGDPLNNTTPVTGASPGGLRELQLRSLTEI

SEQ ID NO: 5942 - protein, 40 aa, Artificial Sequence
  Description of Artificial Sequence: Synthetic polypeptide
YALAVLDNGDPLNNTTPVTGASPGGLRELQLRSLTEILKG

SEQ ID NO: 5943 - protein, 40 aa, Artificial Sequence
  Description of Artificial Sequence: Synthetic polypeptide
MAVLDNGDPLNNTTPVTGASPGGLRELQLRSLTEILKGGV

SEQ ID NO: 5944 - protein, 40 aa, Artificial Sequence
  Description of Artificial Sequence: Synthetic polypeptide
GDPLNNTTPVTGASPGGLRELQLRSLTEILKGGVLIQRNP

SEQ ID NO: 5945 - protein, 40 aa, Artificial Sequence
  Description of Artificial Sequence: Synthetic polypeptide
PLNNTTPVTGASPGGLRELQLRSLTEILKGGVLIQRNPQL

SEQ ID NO: 5946 - protein, 40 aa, Artificial Sequence
  Description of Artificial Sequence: Synthetic polypeptide
MNNTTPVTGASPGGLRELQLRSLTEILKGGVLIQRNPQLC

SEQ ID NO: 5947 - protein, 40 aa, Artificial Sequence
  Description of Artificial Sequence: Synthetic polypeptide
NNTTPVTGASPGGLRELQLRSLTEILKGGVLIQRNPQLCY

SEQ ID NO: 5948 - protein, 40 aa, Artificial Sequence
  Description of Artificial Sequence: Synthetic polypeptide
NTTPVTGASPGGLRELQLRSLTEILKGGVLIQRNPQLCYQ

SEQ ID NO: 5949 - protein, 40 aa, Artificial Sequence
  Description of Artificial Sequence: Synthetic polypeptide
TTPVTGASPGGLRELQLRSLTEILKGGVLIQRNPQLCYQD

SEQ ID NO: 5950 - protein, 40 aa, Artificial Sequence
  Description of Artificial Sequence: Synthetic polypeptide
VTGASPGGLRELQLRSLTEILKGGVLIQRNPQLCYQDTIL

SEQ ID NO: 5951 - protein, 40 aa, Artificial Sequence
  Description of Artificial Sequence: Synthetic polypeptide
TGASPGGLRELQLRSLTEILKGGVLIQRNPQLCYQDTILW

SEQ ID NO: 5952 - protein, 40 aa, Artificial Sequence
  Description of Artificial Sequence: Synthetic polypeptide
HPCSPMCKGSRCWGESSEDCQSLTRTVCAGGCARCKGPLP

SEQ ID NO: 5953 - protein, 40 aa, Artificial Sequence
  Description of Artificial Sequence: Synthetic polypeptide
SRCWGESSEDCQSLTRTVCAGGCARCKGPLPTDCCHEQCA

SEQ ID NO: 5954 - protein, 40 aa, Artificial Sequence
  Description of Artificial Sequence: Synthetic polypeptide
KGPLPTDCCHEQCAAGCTGPKHSDCLACLHFNHSGICELH

SEQ ID NO: 5955 - protein, 40 aa, Artificial Sequence
  Description of Artificial Sequence: Synthetic polypeptide
TFGASCVTACPYNYLSTDVGSCTLVCPLHNQEVTAEDGTQ

SEQ ID NO: 5956 - protein, 40 aa, Artificial Sequence
  Description of Artificial Sequence: Synthetic polypeptide
MHNQEVTAEDGTQRCEKCSKPCARVCYGLGMEHLREVRAV

SEQ ID NO: 5957 - protein, 40 aa, Artificial Sequence
  Description of Artificial Sequence: Synthetic polypeptide
EVTAEDGTQRCEKCSKPCARVCYGLGMEHLREVRAVTSAN

SEQ ID NO: 5958 - protein, 40 aa, Artificial Sequence
  Description of Artificial Sequence: Synthetic polypeptide
EDGTQRCEKCSKPCARVCYGLGMEHLREVRAVTSANIQEF

SEQ ID NO: 5959 - protein, 40 aa, Artificial Sequence
  Description of Artificial Sequence: Synthetic polypeptide
GTQRCEKCSKPCARVCYGLGMEHLREVRAVTSANIQEFAG

SEQ ID NO: 5960 - protein, 40 aa, Artificial Sequence
  Description of Artificial Sequence: Synthetic polypeptide
PCARVCYGLGMEHLREVRAVTSANIQEFAGCKKIFGSLAF

SEQ ID NO: 5961 - protein, 40 aa, Artificial Sequence
  Description of Artificial Sequence: Synthetic polypeptide
CYGLGMEHLREVRAVTSANIQEFAGCKKIFGSLAFLPESF

SEQ ID NO: 5962 - protein, 40 aa, Artificial Sequence
  Description of Artificial Sequence: Synthetic polypeptide
RGRILHNGAYSLTLQGLGISWLGLRSLRELGSGLALIHHN

SEQ ID NO: 5963 - protein, 40 aa, Artificial Sequence
  Description of Artificial Sequence: Synthetic polypeptide
YSLTLQGLGISWLGLRSLRELGSGLALIHHNTHLCFVHTV

SEQ ID NO: 5964 - protein, 40 aa, Artificial Sequence
  Description of Artificial Sequence: Synthetic polypeptide
SLTLQGLGISWLGLRSLRELGSGLALIHHNTHLCFVHTVP

SEQ ID NO: 5965 - protein, 40 aa, Artificial Sequence
  Description of Artificial Sequence: Synthetic polypeptide
CVDLDDKGCPAEQRASPLTSIISAVVGILLVVVLGVVFGI

SEQ ID NO: 5966 - protein, 40 aa, Artificial Sequence
  Description of Artificial Sequence: Synthetic polypeptide
GCPAEQRASPLTSIISAVVGILLVVVLGVVFGILIKRRQQ

SEQ ID NO: 5967 - protein, 40 aa, Artificial Sequence
  Description of Artificial Sequence: Synthetic polypeptide
CPAEQRASPLTSIISAVVGILLVVVLGVVFGILIKRRQQK

SEQ ID NO: 5968 - protein, 40 aa, Artificial Sequence
  Description of Artificial Sequence: Synthetic polypeptide
IRKYTMRRLLQETELVEPLTPSGAMPNQAQMRILKETELR

SEQ ID NO: 5969 - protein, 40 aa, Artificial Sequence
  Description of Artificial Sequence: Synthetic polypeptide
TMRRLLQETELVEPLTPSGAMPNQAQMRILKETELRKVKV

SEQ ID NO: 5970 - protein, 40 aa, Artificial Sequence
  Description of Artificial Sequence: Synthetic polypeptide
MRRLLQETELVEPLTPSGAMPNQAQMRILKETELRKVKVL

SEQ ID NO: 5971 - protein, 40 aa, Artificial Sequence
  Description of Artificial Sequence: Synthetic polypeptide
ETELRKVKVLGSGAFGTVYKGIWIPDGENVKIPVAIKVLR

SEQ ID NO: 5972 - protein, 40 aa, Artificial Sequence
  Description of Artificial Sequence: Synthetic polypeptide
GTVYKGIWIPDGENVKIPVAIKVLRENTSPKANKEILDEA

SEQ ID NO: 5973 - protein, 40 aa, Artificial Sequence
  Description of Artificial Sequence: Synthetic polypeptide
RLLGICLTSTVQLVTQLMPYGCLLDHVRENRGRLGSQDLL

SEQ ID NO: 5974 - protein, 40 aa, Artificial Sequence
  Description of Artificial Sequence: Synthetic polypeptide
SLLEDDDMGDLVDAEEYLVPQQGFFCPDPAPGAGGMVHHR

SEQ ID NO: 5975 - protein, 40 aa, Artificial Sequence
  Description of Artificial Sequence: Synthetic polypeptide
DPAPGAGGMVHHRHRSSSTRSGGGDLTLGLEPSEEEAPRS

SEQ ID NO: 5976 - protein, 40 aa, Artificial Sequence
  Description of Artificial Sequence: Synthetic polypeptide
PGAGGMVHHRHRSSSTRSGGGDLTLGLEPSEEEAPRSPLA

SEQ ID NO: 5977 - protein, 40 aa, Artificial Sequence
  Description of Artificial Sequence: Synthetic polypeptide
GMVHHRHRSSSTRSGGGDLTLGLEPSEEEAPRSPLAPSEG

SEQ ID NO: 5978 - protein, 40 aa, Artificial Sequence
  Description of Artificial Sequence: Synthetic polypeptide
SSSTRSGGGDLTLGLEPSEEEAPRSPLAPSEGAGSDVFDG

SEQ ID NO: 5979 - protein, 40 aa, Artificial Sequence
  Description of Artificial Sequence: Synthetic polypeptide
QPHPPPAFSPAFDNLYYWDQDPPERGAPPSTFKGTPTAEN

SEQ ID NO: 5980 - protein, 40 aa, Artificial Sequence
  Description of Artificial Sequence: Synthetic polypeptide
AFSPAFDNLYYWDQDPPERGAPPSTFKGTPTAENPEYLGL

SEQ ID NO: 5981 - protein, 40 aa, Artificial Sequence
  Description of Artificial Sequence: Synthetic polypeptide
MGLLFSLARGSEVGNSQAVCPGTLNGLSVTGDAENQYQTL

SEQ ID NO: 5982 - protein, 40 aa, Artificial Sequence
  Description of Artificial Sequence: Synthetic polypeptide
RGSEVGNSQAVCPGTLNGLSVTGDAENQYQTLYKLYERCE

SEQ ID NO: 5983 - protein, 40 aa, Artificial Sequence
  Description of Artificial Sequence: Synthetic polypeptide
MGNLEIVLTGHNADLSFLQWIREVTGYVLVAMNEFSTLPL

SEQ ID NO: 5984 - protein, 40 aa, Artificial Sequence
  Description of Artificial Sequence: Synthetic polypeptide
VYDGKFAIFVMLNYNTNSSHALRQLRLTQLTEILSGGVYI

SEQ ID NO: 5985 - protein, 40 aa, Artificial Sequence
  Description of Artificial Sequence: Synthetic polypeptide
FAIFVMLNYNTNSSHALRQLRLTQLTEILSGGVYIEKNDK

SEQ ID NO: 5986 - protein, 40 aa, Artificial Sequence
  Description of Artificial Sequence: Synthetic polypeptide
RACPPDKMEVDKNGLKMCEPCGGLCPKACEGTGSGSRFQT

SEQ ID NO: 5987 - protein, 40 aa, Artificial Sequence
  Description of Artificial Sequence: Synthetic polypeptide
DKMEVDKNGLKMCEPCGGLCPKACEGTGSGSRFQTVDSSN

SEQ ID NO: 5988 - protein, 40 aa, Artificial Sequence
  Description of Artificial Sequence: Synthetic polypeptide
VDKNGLKMCEPCGGLCPKACEGTGSGSRFQTVDSSNIDGF

SEQ ID NO: 5989 - protein, 40 aa, Artificial Sequence
  Description of Artificial Sequence: Synthetic polypeptide
GLKMCEPCGGLCPKACEGTGSGSRFQTVDSSNIDGFVNCT

SEQ ID NO: 5990 - protein, 40 aa, Artificial Sequence
  Description of Artificial Sequence: Synthetic polypeptide
VREITGYLNIQSWPPHMHNFSVFSNLTTIGGRSLYNRGFS

SEQ ID NO: 5991 - protein, 40 aa, Artificial Sequence
  Description of Artificial Sequence: Synthetic polypeptide
ITGYLNIQSWPPHMHNFSVFSNLTTIGGRSLYNRGFSLLI

SEQ ID NO: 5992 - protein, 40 aa, Artificial Sequence
  Description of Artificial Sequence: Synthetic polypeptide
YLNIQSWPPHMHNFSVFSNLTTIGGRSLYNRGFSLLIMKN

SEQ ID NO: 5993 - protein, 40 aa, Artificial Sequence
  Description of Artificial Sequence: Synthetic polypeptide
NIQSWPPHMHNFSVFSNLTTIGGRSLYNRGFSLLIMKNLN

SEQ ID NO: 5994 - protein, 40 aa, Artificial Sequence
  Description of Artificial Sequence: Synthetic polypeptide
IQSWPPHMHNFSVFSNLTTIGGRSLYNRGFSLLIMKNLNV

SEQ ID NO: 5995 - protein, 40 aa, Artificial Sequence
  Description of Artificial Sequence: Synthetic polypeptide
PPHMHNFSVFSNLTTIGGRSLYNRGFSLLIMKNLNVTSLG

SEQ ID NO: 5996 - protein, 40 aa, Artificial Sequence
  Description of Artificial Sequence: Synthetic polypeptide
HMHNFSVFSNLTTIGGRSLYNRGFSLLIMKNLNVTSLGFR

SEQ ID NO: 5997 - protein, 40 aa, Artificial Sequence
  Description of Artificial Sequence: Synthetic polypeptide
MHNFSVFSNLTTIGGRSLYNRGFSLLIMKNLNVTSLGFRS

SEQ ID NO: 5998 - protein, 40 aa, Artificial Sequence
  Description of Artificial Sequence: Synthetic polypeptide
HNFSVFSNLTTIGGRSLYNRGFSLLIMKNLNVTSLGFRSL

SEQ ID NO: 5999 - protein, 40 aa, Artificial Sequence
  Description of Artificial Sequence: Synthetic polypeptide
FSVFSNLTTIGGRSLYNRGFSLLIMKNLNVTSLGFRSLKE

SEQ ID NO: 6000 - protein, 40 aa, Artificial Sequence
  Description of Artificial Sequence: Synthetic polypeptide
SVFSNLTTIGGRSLYNRGFSLLIMKNLNVTSLGFRSLKEI

SEQ ID NO: 6001 - protein, 40 aa, Artificial Sequence
  Description of Artificial Sequence: Synthetic polypeptide
SNLTTIGGRSLYNRGFSLLIMKNLNVTSLGFRSLKEISAG

SEQ ID NO: 6002 - protein, 40 aa, Artificial Sequence
  Description of Artificial Sequence: Synthetic polypeptide
NLTTIGGRSLYNRGFSLLIMKNLNVTSLGFRSLKEISAGR

SEQ ID NO: 6003 - protein, 40 aa, Artificial Sequence
  Description of Artificial Sequence: Synthetic polypeptide
MTTIGGRSLYNRGFSLLIMKNLNVTSLGFRSLKEISAGRI

SEQ ID NO: 6004 - protein, 40 aa, Artificial Sequence
  Description of Artificial Sequence: Synthetic polypeptide
TTIGGRSLYNRGFSLLIMKNLNVTSLGFRSLKEISAGRIY

SEQ ID NO: 6005 - protein, 40 aa, Artificial Sequence
  Description of Artificial Sequence: Synthetic polypeptide
TIGGRSLYNRGFSLLIMKNLNVTSLGFRSLKEISAGRIYI

SEQ ID NO: 6006 - protein, 40 aa, Artificial Sequence
  Description of Artificial Sequence: Synthetic polypeptide
IGGRSLYNRGFSLLIMKNLNVTSLGFRSLKEISAGRIYIS

SEQ ID NO: 6007 - protein, 40 aa, Artificial Sequence
  Description of Artificial Sequence: Synthetic polypeptide
GGRSLYNRGFSLLIMKNLNVTSLGFRSLKEISAGRIYISA

SEQ ID NO: 6008 - protein, 40 aa, Artificial Sequence
  Description of Artificial Sequence: Synthetic polypeptide
GRSLYNRGFSLLIMKNLNVTSLGFRSLKEISAGRIYISAN

SEQ ID NO: 6009 - protein, 40 aa, Artificial Sequence
  Description of Artificial Sequence: Synthetic polypeptide
RSLYNRGFSLLIMKNLNVTSLGFRSLKEISAGRIYISANR

SEQ ID NO: 6010 - protein, 40 aa, Artificial Sequence
  Description of Artificial Sequence: Synthetic polypeptide
SLYNRGFSLLIMKNLNVTSLGFRSLKEISAGRIYISANRQ

SEQ ID NO: 6011 - protein, 40 aa, Artificial Sequence
  Description of Artificial Sequence: Synthetic polypeptide
YNRGFSLLIMKNLNVTSLGFRSLKEISAGRIYISANRQLC

SEQ ID NO: 6012 - protein, 40 aa, Artificial Sequence
  Description of Artificial Sequence: Synthetic polypeptide
NRGFSLLIMKNLNVTSLGFRSLKEISAGRIYISANRQLCY

SEQ ID NO: 6013 - protein, 40 aa, Artificial Sequence
  Description of Artificial Sequence: Synthetic polypeptide
RGFSLLIMKNLNVTSLGFRSLKEISAGRIYISANRQLCYH

SEQ ID NO: 6014 - protein, 40 aa, Artificial Sequence
  Description of Artificial Sequence: Synthetic polypeptide
GFSLLIMKNLNVTSLGFRSLKEISAGRIYISANRQLCYHH

SEQ ID NO: 6015 - protein, 40 aa, Artificial Sequence
  Description of Artificial Sequence: Synthetic polypeptide
ANRQLCYHHSLNWTKVLRGPTEERLDIKHNRPRRDCVAEG

SEQ ID NO: 6016 - protein, 40 aa, Artificial Sequence
  Description of Artificial Sequence: Synthetic polypeptide
SSGGCWGPGPGQCLSCRNYSRGGVCVTHCNFLNGEPREFA

SEQ ID NO: 6017 - protein, 40 aa, Artificial Sequence
  Description of Artificial Sequence: Synthetic polypeptide
VLIGKTHLTMALTVIAGLVVIFMMLGGTFLYWRGRRIQNK

SEQ ID NO: 6018 - protein, 40 aa, Artificial Sequence
  Description of Artificial Sequence: Synthetic polypeptide
GKTHLTMALTVIAGLVVIFMMLGGTFLYWRGRRIQNKRAM

SEQ ID NO: 6019 - protein, 40 aa, Artificial Sequence
  Description of Artificial Sequence: Synthetic polypeptide
KTHLTMALTVIAGLVVIFMMLGGTFLYWRGRRIQNKRAMR

SEQ ID NO: 6020 - protein, 40 aa, Artificial Sequence
  Description of Artificial Sequence: Synthetic polypeptide
ALTVIAGLVVIFMMLGGTFLYWRGRRIQNKRAMRRYLERG

SEQ ID NO: 6021 - protein, 40 aa, Artificial Sequence
  Description of Artificial Sequence: Synthetic polypeptide
MTVIAGLVVIFMMLGGTFLYWRGRRIQNKRAMRRYLERGE

SEQ ID NO: 6022 - protein, 40 aa, Artificial Sequence
  Description of Artificial Sequence: Synthetic polypeptide
MVVIFMMLGGTFLYWRGRRIQNKRAMRRYLERGESIEPLD

SEQ ID NO: 6023 - protein, 40 aa, Artificial Sequence
  Description of Artificial Sequence: Synthetic polypeptide
VIFMMLGGTFLYWRGRRIQNKRAMRRYLERGESIEPLDPS

SEQ ID NO: 6024 - protein, 40 aa, Artificial Sequence
  Description of Artificial Sequence: Synthetic polypeptide
IFMMLGGTFLYWRGRRIQNKRAMRRYLERGESIEPLDPSE

SEQ ID NO: 6025 - protein, 40 aa, Artificial Sequence
  Description of Artificial Sequence: Synthetic polypeptide
MGGTFLYWRGRRIQNKRAMRRYLERGESIEPLDPSEKANK

SEQ ID NO: 6026 - protein, 40 aa, Artificial Sequence
  Description of Artificial Sequence: Synthetic polypeptide
GGTFLYWRGRRIQNKRAMRRYLERGESIEPLDPSEKANKV

SEQ ID NO: 6027 - protein, 40 aa, Artificial Sequence
  Description of Artificial Sequence: Synthetic polypeptide
GTFLYWRGRRIQNKRAMRRYLERGESIEPLDPSEKANKVL

SEQ ID NO: 6028 - protein, 40 aa, Artificial Sequence
  Description of Artificial Sequence: Synthetic polypeptide
WRGRRIQNKRAMRRYLERGESIEPLDPSEKANKVLARIFK

SEQ ID NO: 6029 - protein, 40 aa, Artificial Sequence
  Description of Artificial Sequence: Synthetic polypeptide
RGRRIQNKRAMRRYLERGESIEPLDPSEKANKVLARIFKE

SEQ ID NO: 6030 - protein, 40 aa, Artificial Sequence
  Description of Artificial Sequence: Synthetic polypeptide
IQNKRAMRRYLERGESIEPLDPSEKANKVLARIFKETELR

SEQ ID NO: 6031 - protein, 40 aa, Artificial Sequence
  Description of Artificial Sequence: Synthetic polypeptide
RYLERGESIEPLDPSEKANKVLARIFKETELRKLKVLGSG

SEQ ID NO: 6032 - protein, 40 aa, Artificial Sequence
  Description of Artificial Sequence: Synthetic polypeptide
YLERGESIEPLDPSEKANKVLARIFKETELRKLKVLGSGV

SEQ ID NO: 6033 - protein, 40 aa, Artificial Sequence
  Description of Artificial Sequence: Synthetic polypeptide
DPSEKANKVLARIFKETELRKLKVLGSGVFGTVHKGVWIP

SEQ ID NO: 6034 - protein, 40 aa, Artificial Sequence
  Description of Artificial Sequence: Synthetic polypeptide
SIKIPVCIKVIEDKSGRQSFQAVTDHMLAIGSLDHAHIVR

SEQ ID NO: 6035 - protein, 40 aa, Artificial Sequence
  Description of Artificial Sequence: Synthetic polypeptide
PLGSLLDHVRQHRGALGPQLLLNWGVQIAKGMYYLEEHGM

SEQ ID NO: 6036 - protein, 40 aa, Artificial Sequence
  Description of Artificial Sequence: Synthetic polypeptide
SLLDHVRQHRGALGPQLLLNWGVQIAKGMYYLEEHGMVHR

SEQ ID NO: 6037 - protein, 40 aa, Artificial Sequence
  Description of Artificial Sequence: Synthetic polypeptide
GALGPQLLLNWGVQIAKGMYYLEEHGMVHRNLAARNVLLK

SEQ ID NO: 6038 - protein, 40 aa, Artificial Sequence
  Description of Artificial Sequence: Synthetic polypeptide
MALESIHFGKYTHQSDVWSYGVTVWELMTFGAEPYAGLRL

SEQ ID NO: 6039 - protein, 40 aa, Artificial Sequence
  Description of Artificial Sequence: Synthetic polypeptide
KYTHQSDVWSYGVTVWELMTFGAEPYAGLRLAEVPDLLEK

SEQ ID NO: 6040 - protein, 40 aa, Artificial Sequence
  Description of Artificial Sequence: Synthetic polypeptide
ELMTFGAEPYAGLRLAEVPDLLEKGERLAQPQICTIDVYM

SEQ ID NO: 6041 - protein, 40 aa, Artificial Sequence
  Description of Artificial Sequence: Synthetic polypeptide
FTRMARDPPRYLVIKRESGPGIAPGPEPHGLTNKKLEEVE

SEQ ID NO: 6042 - protein, 40 aa, Artificial Sequence
  Description of Artificial Sequence: Synthetic polypeptide
RDPPRYLVIKRESGPGIAPGPEPHGLTNKKLEEVELEPEL

SEQ ID NO: 6043 - protein, 40 aa, Artificial Sequence
  Description of Artificial Sequence: Synthetic polypeptide
YLVIKRESGPGIAPGPEPHGLTNKKLEEVELEPELDLDLD

SEQ ID NO: 6044 - protein, 40 aa, Artificial Sequence
  Description of Artificial Sequence: Synthetic polypeptide
IKRESGPGIAPGPEPHGLTNKKLEEVELEPELDLDLDLEA

SEQ ID NO: 6045 - protein, 40 aa, Artificial Sequence
  Description of Artificial Sequence: Synthetic polypeptide
LNRPRGSQSLLSPSSGYMPMNQGNLGESCQESAVSGSSER

SEQ ID NO: 6046 - protein, 40 aa, Artificial Sequence
  Description of Artificial Sequence: Synthetic polypeptide
SLLTPVTPLSPPGLEEEDVNGYVMPDTHLKGTPSSREGTL

SEQ ID NO: 6047 - protein, 40 aa, Artificial Sequence
  Description of Artificial Sequence: Synthetic polypeptide
VTPLSPPGLEEEDVNGYVMPDTHLKGTPSSREGTLSSVGL

SEQ ID NO: 6048 - protein, 40 aa, Artificial Sequence
  Description of Artificial Sequence: Synthetic polypeptide
PPGLEEEDVNGYVMPDTHLKGTPSSREGTLSSVGLSSVLG

SEQ ID NO: 6049 - protein, 40 aa, Artificial Sequence
  Description of Artificial Sequence: Synthetic polypeptide
PGLEEEDVNGYVMPDTHLKGTPSSREGTLSSVGLSSVLGT

SEQ ID NO: 6050 - protein, 40 aa, Artificial Sequence
  Description of Artificial Sequence: Synthetic polypeptide
GLEEEDVNGYVMPDTHLKGTPSSREGTLSSVGLSSVLGTE

SEQ ID NO: 6051 - protein, 40 aa, Artificial Sequence
  Description of Artificial Sequence: Synthetic polypeptide
EGTLSSVGLSSVLGTEEEDEDEEYEYMNRRRRHSPPHPPR

SEQ ID NO: 6052 - protein, 40 aa, Artificial Sequence
  Description of Artificial Sequence: Synthetic polypeptide
YEYMNRQRDGGGPGGDYAAMGACPASEQGYEEMRAFQGPG

SEQ ID NO: 6053 - protein, 40 aa, Artificial Sequence
  Description of Artificial Sequence: Synthetic polypeptide
NRQRDGGGPGGDYAAMGACPASEQGYEEMRAFQGPGHQAP

SEQ ID NO: 6054 - protein, 40 aa, Artificial Sequence
  Description of Artificial Sequence: Synthetic polypeptide
DGGGPGGDYAAMGACPASEQGYEEMRAFQGPGHQAPHVHY

SEQ ID NO: 6055 - protein, 40 aa, Artificial Sequence
  Description of Artificial Sequence: Synthetic polypeptide
GGGPGGDYAAMGACPASEQGYEEMRAFQGPGHQAPHVHYA

SEQ ID NO: 6056 - protein, 40 aa, Artificial Sequence
  Description of Artificial Sequence: Synthetic polypeptide
GGPGGDYAAMGACPASEQGYEEMRAFQGPGHQAPHVHYAR

SEQ ID NO: 6057 - protein, 40 aa, Artificial Sequence
  Description of Artificial Sequence: Synthetic polypeptide
GPGGDYAAMGACPASEQGYEEMRAFQGPGHQAPHVHYARL

SEQ ID NO: 6058 - protein, 40 aa, Artificial Sequence
  Description of Artificial Sequence: Synthetic polypeptide
YAAMGACPASEQGYEEMRAFQGPGHQAPHVHYARLKTLRS

SEQ ID NO: 6059 - protein, 40 aa, Artificial Sequence
  Description of Artificial Sequence: Synthetic polypeptide
GACPASEQGYEEMRAFQGPGHQAPHVHYARLKTLRSLEAT

SEQ ID NO: 6060 - protein, 40 aa, Artificial Sequence
  Description of Artificial Sequence: Synthetic polypeptide
ACPASEQGYEEMRAFQGPGHQAPHVHYARLKTLRSLEATD

SEQ ID NO: 6061 - protein, 40 aa, Artificial Sequence
  Description of Artificial Sequence: Synthetic polypeptide
PASEQGYEEMRAFQGPGHQAPHVHYARLKTLRSLEATDSA

SEQ ID NO: 6062 - protein, 40 aa, Artificial Sequence
  Description of Artificial Sequence: Synthetic polypeptide
GYEEMRAFQGPGHQAPHVHYARLKTLRSLEATDSAFDNPD

SEQ ID NO: 6063 - protein, 40 aa, Artificial Sequence
  Description of Artificial Sequence: Synthetic polypeptide
EEMRAFQGPGHQAPHVHYARLKTLRSLEATDSAFDNPDYW

SEQ ID NO: 6064 - protein, 40 aa, Artificial Sequence
  Description of Artificial Sequence: Synthetic polypeptide
EMRAFQGPGHQAPHVHYARLKTLRSLEATDSAFDNPDYWH

SEQ ID NO: 6065 - protein, 40 aa, Artificial Sequence
  Description of Artificial Sequence: Synthetic polypeptide
ENKLSSLSDLEQQYRALRKYYENCEVVMGNLEITSIEHNR

SEQ ID NO: 6066 - protein, 40 aa, Artificial Sequence
  Description of Artificial Sequence: Synthetic polypeptide
CEVVMGNLEITSIEHNRDLSFLRSVREVTGYVLVALNQFR

SEQ ID NO: 6067 - protein, 40 aa, Artificial Sequence
  Description of Artificial Sequence: Synthetic polypeptide
EHNRDLSFLRSVREVTGYVLVALNQFRYLPLENLRIIRGT

SEQ ID NO: 6068 - protein, 40 aa, Artificial Sequence
  Description of Artificial Sequence: Synthetic polypeptide
NRDLSFLRSVREVTGYVLVALNQFRYLPLENLRIIRGTKL

SEQ ID NO: 6069 - protein, 40 aa, Artificial Sequence
  Description of Artificial Sequence: Synthetic polypeptide
FLRSVREVTGYVLVALNQFRYLPLENLRIIRGTKLYEDRY

SEQ ID NO: 6070 - protein, 40 aa, Artificial Sequence
  Description of Artificial Sequence: Synthetic polypeptide
MRSVREVTGYVLVALNQFRYLPLENLRIIRGTKLYEDRYA

SEQ ID NO: 6071 - protein, 40 aa, Artificial Sequence
  Description of Artificial Sequence: Synthetic polypeptide
TGYVLVALNQFRYLPLENLRIIRGTKLYEDRYALAIFLNY

SEQ ID NO: 6072 - protein, 40 aa, Artificial Sequence
  Description of Artificial Sequence: Synthetic polypeptide
VALNQFRYLPLENLRIIRGTKLYEDRYALAIFLNYRKDGN

SEQ ID NO: 6073 - protein, 40 aa, Artificial Sequence
  Description of Artificial Sequence: Synthetic polypeptide
LNQFRYLPLENLRIIRGTKLYEDRYALAIFLNYRKDGNFG

SEQ ID NO: 6074 - protein, 40 aa, Artificial Sequence
  Description of Artificial Sequence: Synthetic polypeptide
QFRYLPLENLRIIRGTKLYEDRYALAIFLNYRKDGNFGLQ

SEQ ID NO: 6075 - protein, 40 aa, Artificial Sequence
  Description of Artificial Sequence: Synthetic polypeptide
RYLPLENLRIIRGTKLYEDRYALAIFLNYRKDGNFGLQEL

SEQ ID NO: 6076 - protein, 40 aa, Artificial Sequence
  Description of Artificial Sequence: Synthetic polypeptide
MPLENLRIIRGTKLYEDRYALAIFLNYRKDGNFGLQELGL

SEQ ID NO: 6077 - protein, 40 aa, Artificial Sequence
  Description of Artificial Sequence: Synthetic polypeptide
PLENLRIIRGTKLYEDRYALAIFLNYRKDGNFGLQELGLK

SEQ ID NO: 6078 - protein, 40 aa, Artificial Sequence
  Description of Artificial Sequence: Synthetic polypeptide
MENLRIIRGTKLYEDRYALAIFLNYRKDGNFGLQELGLKN

SEQ ID NO: 6079 - protein, 40 aa, Artificial Sequence
  Description of Artificial Sequence: Synthetic polypeptide
LRIIRGTKLYEDRYALAIFLNYRKDGNFGLQELGLKNLTE

SEQ ID NO: 6080 - protein, 40 aa, Artificial Sequence
  Description of Artificial Sequence: Synthetic polypeptide
TKLYEDRYALAIFLNYRKDGNFGLQELGLKNLTEILNGGV

SEQ ID NO: 6081 - protein, 40 aa, Artificial Sequence
  Description of Artificial Sequence: Synthetic polypeptide
LNYRKDGNFGLQELGLKNLTEILNGGVYVDQNKFLCYADT

SEQ ID NO: 6082 - protein, 40 aa, Artificial Sequence
  Description of Artificial Sequence: Synthetic polypeptide
YRKDGNFGLQELGLKNLTEILNGGVYVDQNKFLCYADTIH

SEQ ID NO: 6083 - protein, 40 aa, Artificial Sequence
  Description of Artificial Sequence: Synthetic polypeptide
RKDGNFGLQELGLKNLTEILNGGVYVDQNKFLCYADTIHW

SEQ ID NO: 6084 - protein, 40 aa, Artificial Sequence
  Description of Artificial Sequence: Synthetic polypeptide
KDGNFGLQELGLKNLTEILNGGVYVDQNKFLCYADTIHWQ

SEQ ID NO: 6085 - protein, 40 aa, Artificial Sequence
  Description of Artificial Sequence: Synthetic polypeptide
IVRNPWPSNLTLVSTNGSSGCGRCHKSCTGRCWGPTENHC

SEQ ID NO: 6086 - protein, 40 aa, Artificial Sequence
  Description of Artificial Sequence: Synthetic polypeptide
LVSTNGSSGCGRCHKSCTGRCWGPTENHCQTLTRTVCAEQ

SEQ ID NO: 6087 - protein, 40 aa, Artificial Sequence
  Description of Artificial Sequence: Synthetic polypeptide
TVCAEQCDGRCYGPYVSDCCHRECAGGCSGPKDTDCFACM

SEQ ID NO: 6088 - protein, 40 aa, Artificial Sequence
  Description of Artificial Sequence: Synthetic polypeptide
YGAFCVKKCPHNFVVDSSSCVRACPSSKMEVEENGIKMCK

SEQ ID NO: 6089 - protein, 40 aa, Artificial Sequence
  Description of Artificial Sequence: Synthetic polypeptide
GAFCVKKCPHNFVVDSSSCVRACPSSKMEVEENGIKMCKP

SEQ ID NO: 6090 - protein, 40 aa, Artificial Sequence
  Description of Artificial Sequence: Synthetic polypeptide
NGIKMCKPCTDICPKACDGIGTGSLMSAQTVDSSNIDKFI

SEQ ID NO: 6091 - protein, 40 aa, Artificial Sequence
  Description of Artificial Sequence: Synthetic polypeptide
CTDICPKACDGIGTGSLMSAQTVDSSNIDKFINCTKINGN

SEQ ID NO: 6092 - protein, 40 aa, Artificial Sequence
  Description of Artificial Sequence: Synthetic polypeptide
CDGIGTGSLMSAQTVDSSNIDKFINCTKINGNLIFLVTGI

SEQ ID NO: 6093 - protein, 40 aa, Artificial Sequence
  Description of Artificial Sequence: Synthetic polypeptide
DKFINCTKINGNLIFLVTGIHGDPYNAIEAIDPEKLNVFR

SEQ ID NO: 6094 - protein, 40 aa, Artificial Sequence
  Description of Artificial Sequence: Synthetic polypeptide
KFINCTKINGNLIFLVTGIHGDPYNAIEAIDPEKLNVFRT

SEQ ID NO: 6095 - protein, 40 aa, Artificial Sequence
  Description of Artificial Sequence: Synthetic polypeptide
INCTKINGNLIFLVTGIHGDPYNAIEAIDPEKLNVFRTVR

SEQ ID NO: 6096 - protein, 40 aa, Artificial Sequence
  Description of Artificial Sequence: Synthetic polypeptide
CTKINGNLIFLVTGIHGDPYNAIEAIDPEKLNVFRTVREI

SEQ ID NO: 6097 - protein, 40 aa, Artificial Sequence
  Description of Artificial Sequence: Synthetic polypeptide
VFRTVREITGFLNIQSWPPNMTDFSVFSNLVTIGGRVLYS

SEQ ID NO: 6098 - protein, 40 aa, Artificial Sequence
  Description of Artificial Sequence: Synthetic polypeptide
ITGFLNIQSWPPNMTDFSVFSNLVTIGGRVLYSGLSLLIL

SEQ ID NO: 6099 - protein, 40 aa, Artificial Sequence
  Description of Artificial Sequence: Synthetic polypeptide
FLNIQSWPPNMTDFSVFSNLVTIGGRVLYSGLSLLILKQQ

SEQ ID NO: 6100 - protein, 40 aa, Artificial Sequence
  Description of Artificial Sequence: Synthetic polypeptide
QSWPPNMTDFSVFSNLVTIGGRVLYSGLSLLILKQQGITS

SEQ ID NO: 6101 - protein, 40 aa, Artificial Sequence
  Description of Artificial Sequence: Synthetic polypeptide
SWPPNMTDFSVFSNLVTIGGRVLYSGLSLLILKQQGITSL

SEQ ID NO: 6102 - protein, 40 aa, Artificial Sequence
  Description of Artificial Sequence: Synthetic polypeptide
VFSNLVTIGGRVLYSGLSLLILKQQGITSLQFQSLKEISA

SEQ ID NO: 6103 - protein, 40 aa, Artificial Sequence
  Description of Artificial Sequence: Synthetic polypeptide
SGLSLLILKQQGITSLQFQSLKEISAGNIYITDNSNLCYY

SEQ ID NO: 6104 - protein, 40 aa, Artificial Sequence
  Description of Artificial Sequence: Synthetic polypeptide
MCYYHTINWTTLFSTINQRIVIRDNRKAENCTAEGMVCNH

SEQ ID NO: 6105 - protein, 40 aa, Artificial Sequence
  Description of Artificial Sequence: Synthetic polypeptide
SDGCWGPGPDQCLSCRRFSRGRICIESCNLYDGEFREFEN

SEQ ID NO: 6106 - protein, 40 aa, Artificial Sequence
  Description of Artificial Sequence: Synthetic polypeptide
DGCWGPGPDQCLSCRRFSRGRICIESCNLYDGEFREFENG

SEQ ID NO: 6107 - protein, 40 aa, Artificial Sequence
  Description of Artificial Sequence: Synthetic polypeptide
GPDQCLSCRRFSRGRICIESCNLYDGEFREFENGSICVEC

SEQ ID NO: 6108 - protein, 40 aa, Artificial Sequence
  Description of Artificial Sequence: Synthetic polypeptide
SHFKDGPNCVEKCPDGLQGANSFIFKYADPDRECHPCHPN

SEQ ID NO: 6109 - protein, 40 aa, Artificial Sequence
  Description of Artificial Sequence: Synthetic polypeptide
YYPWTGHSTLPQHARTPLIAAGVIGGLFILVIVGLTFAVY

SEQ ID NO: 6110 - protein, 40 aa, Artificial Sequence
  Description of Artificial Sequence: Synthetic polypeptide
WTGHSTLPQHARTPLIAAGVIGGLFILVIVGLTFAVYVRR

SEQ ID NO: 6111 - protein, 40 aa, Artificial Sequence
  Description of Artificial Sequence: Synthetic polypeptide
TGHSTLPQHARTPLIAAGVIGGLFILVIVGLTFAVYVRRK

SEQ ID NO: 6112 - protein, 40 aa, Artificial Sequence
  Description of Artificial Sequence: Synthetic polypeptide
TLPQHARTPLIAAGVIGGLFILVIVGLTFAVYVRRKSIKK

SEQ ID NO: 6113 - protein, 40 aa, Artificial Sequence
  Description of Artificial Sequence: Synthetic polypeptide
LPQHARTPLIAAGVIGGLFILVIVGLTFAVYVRRKSIKKK

SEQ ID NO: 6114 - protein, 40 aa, Artificial Sequence
  Description of Artificial Sequence: Synthetic polypeptide
HARTPLIAAGVIGGLFILVIVGLTFAVYVRRKSIKKKRAL

SEQ ID NO: 6115 - protein, 40 aa, Artificial Sequence
  Description of Artificial Sequence: Synthetic polypeptide
MIAAGVIGGLFILVIVGLTFAVYVRRKSIKKKRALRRFLE

SEQ ID NO: 6116 - protein, 40 aa, Artificial Sequence
  Description of Artificial Sequence: Synthetic polypeptide
AAGVIGGLFILVIVGLTFAVYVRRKSIKKKRALRRFLETE

SEQ ID NO: 6117 - protein, 40 aa, Artificial Sequence
  Description of Artificial Sequence: Synthetic polypeptide
GGLFILVIVGLTFAVYVRRKSIKKKRALRRFLETELVEPL

SEQ ID NO: 6118 - protein, 40 aa, Artificial Sequence
  Description of Artificial Sequence: Synthetic polypeptide
GLFILVIVGLTFAVYVRRKSIKKKRALRRFLETELVEPLT

SEQ ID NO: 6119 - protein, 40 aa, Artificial Sequence
  Description of Artificial Sequence: Synthetic polypeptide
LFILVIVGLTFAVYVRRKSIKKKRALRRFLETELVEPLTP

SEQ ID NO: 6120 - protein, 40 aa, Artificial Sequence
  Description of Artificial Sequence: Synthetic polypeptide
FILVIVGLTFAVYVRRKSIKKKRALRRFLETELVEPLTPS

SEQ ID NO: 6121 - protein, 40 aa, Artificial Sequence
  Description of Artificial Sequence: Synthetic polypeptide
ILVIVGLTFAVYVRRKSIKKKRALRRFLETELVEPLTPSG

SEQ ID NO: 6122 - protein, 40 aa, Artificial Sequence
  Description of Artificial Sequence: Synthetic polypeptide
IVGLTFAVYVRRKSIKKKRALRRFLETELVEPLTPSGTAP

SEQ ID NO: 6123 - protein, 40 aa, Artificial Sequence
  Description of Artificial Sequence: Synthetic polypeptide
GLTFAVYVRRKSIKKKRALRRFLETELVEPLTPSGTAPNQ

SEQ ID NO: 6124 - protein, 40 aa, Artificial Sequence
  Description of Artificial Sequence: Synthetic polypeptide
MTFAVYVRRKSIKKKRALRRFLETELVEPLTPSGTAPNQA

SEQ ID NO: 6125 - protein, 40 aa, Artificial Sequence
  Description of Artificial Sequence: Synthetic polypeptide
AVYVRRKSIKKKRALRRFLETELVEPLTPSGTAPNQAQLR

SEQ ID NO: 6126 - protein, 40 aa, Artificial Sequence
  Description of Artificial Sequence: Synthetic polypeptide
VYVRRKSIKKKRALRRFLETELVEPLTPSGTAPNQAQLRI

SEQ ID NO: 6127 - protein, 40 aa, Artificial Sequence
  Description of Artificial Sequence: Synthetic polypeptide
YVRRKSIKKKRALRRFLETELVEPLTPSGTAPNQAQLRIL

SEQ ID NO: 6128 - protein, 40 aa, Artificial Sequence
  Description of Artificial Sequence: Synthetic polypeptide
VRRKSIKKKRALRRFLETELVEPLTPSGTAPNQAQLRILK

SEQ ID NO: 6129 - protein, 40 aa, Artificial Sequence
  Description of Artificial Sequence: Synthetic polypeptide
RRKSIKKKRALRRFLETELVEPLTPSGTAPNQAQLRILKE

SEQ ID NO: 6130 - protein, 40 aa, Artificial Sequence
  Description of Artificial Sequence: Synthetic polypeptide
RKSIKKKRALRRFLETELVEPLTPSGTAPNQAQLRILKET

SEQ ID NO: 6131 - protein, 40 aa, Artificial Sequence
  Description of Artificial Sequence: Synthetic polypeptide
KSIKKKRALRRFLETELVEPLTPSGTAPNQAQLRILKETE

SEQ ID NO: 6132 - protein, 40 aa, Artificial Sequence
  Description of Artificial Sequence: Synthetic polypeptide
SIKKKRALRRFLETELVEPLTPSGTAPNQAQLRILKETEL

SEQ ID NO: 6133 - protein, 40 aa, Artificial Sequence
  Description of Artificial Sequence: Synthetic polypeptide
RFLETELVEPLTPSGTAPNQAQLRILKETELKRVKVLGSG

SEQ ID NO: 6134 - protein, 40 aa, Artificial Sequence
  Description of Artificial Sequence: Synthetic polypeptide
PLTPSGTAPNQAQLRILKETELKRVKVLGSGAFGTVYKGI

SEQ ID NO: 6135 - protein, 40 aa, Artificial Sequence
  Description of Artificial Sequence: Synthetic polypeptide
TPSGTAPNQAQLRILKETELKRVKVLGSGAFGTVYKGIWV

SEQ ID NO: 6136 - protein, 40 aa, Artificial Sequence
  Description of Artificial Sequence: Synthetic polypeptide
SGTAPNQAQLRILKETELKRVKVLGSGAFGTVYKGIWVPE

SEQ ID NO: 6137 - protein, 40 aa, Artificial Sequence
  Description of Artificial Sequence: Synthetic polypeptide
PNQAQLRILKETELKRVKVLGSGAFGTVYKGIWVPEGETV

SEQ ID NO: 6138 - protein, 40 aa, Artificial Sequence
  Description of Artificial Sequence: Synthetic polypeptide
AQLRILKETELKRVKVLGSGAFGTVYKGIWVPEGETVKIP

SEQ ID NO: 6139 - protein, 40 aa, Artificial Sequence
  Description of Artificial Sequence: Synthetic polypeptide
KETELKRVKVLGSGAFGTVYKGIWVPEGETVKIPVAIKIL

SEQ ID NO: 6140 - protein, 40 aa, Artificial Sequence
  Description of Artificial Sequence: Synthetic polypeptide
KRVKVLGSGAFGTVYKGIWVPEGETVKIPVAIKILNETTG

SEQ ID NO: 6141 - protein, 40 aa, Artificial Sequence
  Description of Artificial Sequence: Synthetic polypeptide
RVKVLGSGAFGTVYKGIWVPEGETVKIPVAIKILNETTGP

SEQ ID NO: 6142 - protein, 40 aa, Artificial Sequence
  Description of Artificial Sequence: Synthetic polypeptide
KVLGSGAFGTVYKGIWVPEGETVKIPVAIKILNETTGPKA

SEQ ID NO: 6143 - protein, 40 aa, Artificial Sequence
  Description of Artificial Sequence: Synthetic polypeptide
LGSGAFGTVYKGIWVPEGETVKIPVAIKILNETTGPKANV

SEQ ID NO: 6144 - protein, 40 aa, Artificial Sequence
  Description of Artificial Sequence: Synthetic polypeptide
GSGAFGTVYKGIWVPEGETVKIPVAIKILNETTGPKANVE

SEQ ID NO: 6145 - protein, 40 aa, Artificial Sequence
  Description of Artificial Sequence: Synthetic polypeptide
GAFGTVYKGIWVPEGETVKIPVAIKILNETTGPKANVEFM

SEQ ID NO: 6146 - protein, 40 aa, Artificial Sequence
  Description of Artificial Sequence: Synthetic polypeptide
AFGTVYKGIWVPEGETVKIPVAIKILNETTGPKANVEFMD

SEQ ID NO: 6147 - protein, 40 aa, Artificial Sequence
  Description of Artificial Sequence: Synthetic polypeptide
FGTVYKGIWVPEGETVKIPVAIKILNETTGPKANVEFMDE

SEQ ID NO: 6148 - protein, 40 aa, Artificial Sequence
  Description of Artificial Sequence: Synthetic polypeptide
GTVYKGIWVPEGETVKIPVAIKILNETTGPKANVEFMDEA

SEQ ID NO: 6149 - protein, 40 aa, Artificial Sequence
  Description of Artificial Sequence: Synthetic polypeptide
TVYKGIWVPEGETVKIPVAIKILNETTGPKANVEFMDEAL

SEQ ID NO: 6150 - protein, 40 aa, Artificial Sequence
  Description of Artificial Sequence: Synthetic polypeptide
IWVPEGETVKIPVAIKILNETTGPKANVEFMDEALIMASM

SEQ ID NO: 6151 - protein, 40 aa, Artificial Sequence
  Description of Artificial Sequence: Synthetic polypeptide
ETVKIPVAIKILNETTGPKANVEFMDEALIMASMDHPHLV

SEQ ID NO: 6152 - protein, 40 aa, Artificial Sequence
  Description of Artificial Sequence: Synthetic polypeptide
TVKIPVAIKILNETTGPKANVEFMDEALIMASMDHPHLVR

SEQ ID NO: 6153 - protein, 40 aa, Artificial Sequence
  Description of Artificial Sequence: Synthetic polypeptide
PVAIKILNETTGPKANVEFMDEALIMASMDHPHLVRLLGV

SEQ ID NO: 6154 - protein, 40 aa, Artificial Sequence
  Description of Artificial Sequence: Synthetic polypeptide
VAIKILNETTGPKANVEFMDEALIMASMDHPHLVRLLGVC

SEQ ID NO: 6155 - protein, 40 aa, Artificial Sequence
  Description of Artificial Sequence: Synthetic polypeptide
AIKILNETTGPKANVEFMDEALIMASMDHPHLVRLLGVCL

SEQ ID NO: 6156 - protein, 40 aa, Artificial Sequence
  Description of Artificial Sequence: Synthetic polypeptide
LNETTGPKANVEFMDEALIMASMDHPHLVRLLGVCLSPTI

SEQ ID NO: 6157 - protein, 40 aa, Artificial Sequence
  Description of Artificial Sequence: Synthetic polypeptide
KANVEFMDEALIMASMDHPHLVRLLGVCLSPTIQLVTQLM

SEQ ID NO: 6158 - protein, 40 aa, Artificial Sequence
  Description of Artificial Sequence: Synthetic polypeptide
ALIMASMDHPHLVRLLGVCLSPTIQLVTQLMPHGCLLEYV

SEQ ID NO: 6159 - protein, 40 aa, Artificial Sequence
  Description of Artificial Sequence: Synthetic polypeptide
RLLGVCLSPTIQLVTQLMPHGCLLEYVHEHKDNIGSQLLL

SEQ ID NO: 6160 - protein, 40 aa, Artificial Sequence
  Description of Artificial Sequence: Synthetic polypeptide
MGVCLSPTIQLVTQLMPHGCLLEYVHEHKDNIGSQLLLNW

SEQ ID NO: 6161 - protein, 40 aa, Artificial Sequence
  Description of Artificial Sequence: Synthetic polypeptide
PHGCLLEYVHEHKDNIGSQLLLNWCVQIAKGMMYLEERRL

SEQ ID NO: 6162 - protein, 40 aa, Artificial Sequence
  Description of Artificial Sequence: Synthetic polypeptide
MEYVHEHKDNIGSQLLLNWCVQIAKGMMYLEERRLVHRDL

SEQ ID NO: 6163 - protein, 40 aa, Artificial Sequence
  Description of Artificial Sequence: Synthetic polypeptide
RDLAARNVLVKSPNHVKITDFGLARLLEGDEKEYNADGGK

SEQ ID NO: 6164 - protein, 40 aa, Artificial Sequence
  Description of Artificial Sequence: Synthetic polypeptide
HVKITDFGLARLLEGDEKEYNADGGKMPIKWMALECIHYR

SEQ ID NO: 6165 - protein, 40 aa, Artificial Sequence
  Description of Artificial Sequence: Synthetic polypeptide
QSDVWSYGVTIWELMTFGGKPYDGIPTREIPDLLEKGERL

SEQ ID NO: 6166 - protein, 40 aa, Artificial Sequence
  Description of Artificial Sequence: Synthetic polypeptide
DVWSYGVTIWELMTFGGKPYDGIPTREIPDLLEKGERLPQ

SEQ ID NO: 6167 - protein, 40 aa, Artificial Sequence
  Description of Artificial Sequence: Synthetic polypeptide
GVTIWELMTFGGKPYDGIPTREIPDLLEKGERLPQPPICT

SEQ ID NO: 6168 - protein, 40 aa, Artificial Sequence
  Description of Artificial Sequence: Synthetic polypeptide
DLLEKGERLPQPPICTIDVYMVMVKCWMIDADSRPKFKEL

SEQ ID NO: 6169 - protein, 40 aa, Artificial Sequence
  Description of Artificial Sequence: Synthetic polypeptide
ERLPQPPICTIDVYMVMVKCWMIDADSRPKFKELAAEFSR

SEQ ID NO: 6170 - protein, 40 aa, Artificial Sequence
  Description of Artificial Sequence: Synthetic polypeptide
YMVMVKCWMIDADSRPKFKELAAEFSRMARDPQRYLVIQG

SEQ ID NO: 6171 - protein, 40 aa, Artificial Sequence
  Description of Artificial Sequence: Synthetic polypeptide
PKFKELAAEFSRMARDPQRYLVIQGDDRMKLPSPNDSKFF

SEQ ID NO: 6172 - protein, 40 aa, Artificial Sequence
  Description of Artificial Sequence: Synthetic polypeptide
DPQRYLVIQGDDRMKLPSPNDSKFFQNLLDEEDLEDMMDA

SEQ ID NO: 6173 - protein, 40 aa, Artificial Sequence
  Description of Artificial Sequence: Synthetic polypeptide
CCNGTLRKPVAPHVQEDSSTQRYSADPTVFAPERSPRGEL

SEQ ID NO: 6174 - protein, 40 aa, Artificial Sequence
  Description of Artificial Sequence: Synthetic polypeptide
PVAPHVQEDSSTQRYSADPTVFAPERSPRGELDEEGYMTP

SEQ ID NO: 6175 - protein, 40 aa, Artificial Sequence
  Description of Artificial Sequence: Synthetic polypeptide
VAPHVQEDSSTQRYSADPTVFAPERSPRGELDEEGYMTPM

SEQ ID NO: 6176 - protein, 40 aa, Artificial Sequence
  Description of Artificial Sequence: Synthetic polypeptide
APHVQEDSSTQRYSADPTVFAPERSPRGELDEEGYMTPMR

SEQ ID NO: 6177 - protein, 40 aa, Artificial Sequence
  Description of Artificial Sequence: Synthetic polypeptide
GYMTPMRDKPKQEYLNPVEENPFVSRRKNGDLQALDNPEY

SEQ ID NO: 6178 - protein, 40 aa, Artificial Sequence
  Description of Artificial Sequence: Synthetic polypeptide
PPKAEDEYVNEPLYLNTFANTLGKAEYLKNNILSMPEKAK

SEQ ID NO: 6179 - protein, 40 aa, Artificial Sequence
  Description of Artificial Sequence: Synthetic polypeptide
TLGKAEYLKNNILSMPEKAKKAFDNPDYWNHSLPPRSTLQ

SEQ ID NO: 6180 - protein, 40 aa, Artificial Sequence
  Description of Artificial Sequence: Synthetic polypeptide
KAEYLKNNILSMPEKAKKAFDNPDYWNHSLPPRSTLQHPD

SEQ ID NO: 6181 - protein, 40 aa, Artificial Sequence
  Description of Artificial Sequence: Synthetic polypeptide
QELLSVGSKRRRTGGSLRGNPSSSQVDEEQMNRVVEEEQQ

SEQ ID NO: 6182 - protein, 40 aa, Artificial Sequence
  Description of Artificial Sequence: Synthetic polypeptide
SVGSKRRRTGGSLRGNPSSSQVDEEQMNRVVEEEQQQQLR

SEQ ID NO: 6183 - protein, 40 aa, Artificial Sequence
  Description of Artificial Sequence: Synthetic polypeptide
GGSLRGNPSSSQVDEEQMNRVVEEEQQQQLRQQEEEHTAR

SEQ ID NO: 6184 - protein, 40 aa, Artificial Sequence
  Description of Artificial Sequence: Synthetic polypeptide
GSLRGNPSSSQVDEEQMNRVVEEEQQQQLRQQEEEHTARN

SEQ ID NO: 6185 - protein, 40 aa, Artificial Sequence
  Description of Artificial Sequence: Synthetic polypeptide
GNPSSSQVDEEQMNRVVEEEQQQQLRQQEEEHTARNGEVV

SEQ ID NO: 6186 - protein, 40 aa, Artificial Sequence
  Description of Artificial Sequence: Synthetic polypeptide
GEVVGVEPRPGGQNDSQQGQLEENNNRFISVDEDSSGNQE

SEQ ID NO: 6187 - protein, 40 aa, Artificial Sequence
  Description of Artificial Sequence: Synthetic polypeptide
VEPRPGGQNDSQQGQLEENNNRFISVDEDSSGNQEEQEED

SEQ ID NO: 6188 - protein, 40 aa, Artificial Sequence
  Description of Artificial Sequence: Synthetic polypeptide
SSIVDLPVHQLSSPFYTKTTKMKRKLDHGSEVRSFSLGKK

SEQ ID NO: 6189 - protein, 40 aa, Artificial Sequence
  Description of Artificial Sequence: Synthetic polypeptide
SIVDLPVHQLSSPFYTKTTKMKRKLDHGSEVRSFSLGKKP

SEQ ID NO: 6190 - protein, 40 aa, Artificial Sequence
  Description of Artificial Sequence: Synthetic polypeptide
VHQLSSPFYTKTTKMKRKLDHGSEVRSFSLGKKPCKVSEY

SEQ ID NO: 6191 - protein, 40 aa, Artificial Sequence
  Description of Artificial Sequence: Synthetic polypeptide
HQLSSPFYTKTTKMKRKLDHGSEVRSFSLGKKPCKVSEYT

SEQ ID NO: 6192 - protein, 40 aa, Artificial Sequence
  Description of Artificial Sequence: Synthetic polypeptide
TKTTKMKRKLDHGSEVRSFSLGKKPCKVSEYTSTTGLVPC

SEQ ID NO: 6193 - protein, 40 aa, Artificial Sequence
  Description of Artificial Sequence: Synthetic polypeptide
KTTKMKRKLDHGSEVRSFSLGKKPCKVSEYTSTTGLVPCS

SEQ ID NO: 6194 - protein, 40 aa, Artificial Sequence
  Description of Artificial Sequence: Synthetic polypeptide
TTKMKRKLDHGSEVRSFSLGKKPCKVSEYTSTTGLVPCSA

SEQ ID NO: 6195 - protein, 40 aa, Artificial Sequence
  Description of Artificial Sequence: Synthetic polypeptide
KMKRKLDHGSEVRSFSLGKKPCKVSEYTSTTGLVPCSATP

SEQ ID NO: 6196 - protein, 40 aa, Artificial Sequence
  Description of Artificial Sequence: Synthetic polypeptide
RKLDHGSEVRSFSLGKKPCKVSEYTSTTGLVPCSATPTTF

SEQ ID NO: 6197 - protein, 40 aa, Artificial Sequence
  Description of Artificial Sequence: Synthetic polypeptide
MDHGSEVRSFSLGKKPCKVSEYTSTTGLVPCSATPTTFGD

SEQ ID NO: 6198 - protein, 40 aa, Artificial Sequence
  Description of Artificial Sequence: Synthetic polypeptide
KKPCKVSEYTSTTGLVPCSATPTTFGDLRAANGQGQQRRR

SEQ ID NO: 6199 - protein, 40 aa, Artificial Sequence
  Description of Artificial Sequence: Synthetic polypeptide
VQPPTGLQEWLKMFQSWSGPEKLLALDELIDSCEPTQVKH

SEQ ID NO: 6200 - protein, 40 aa, Artificial Sequence
  Description of Artificial Sequence: Synthetic polypeptide
SGPEKLLALDELIDSCEPTQVKHMMQVIEPQFQRDFISLL

SEQ ID NO: 6201 - protein, 40 aa, Artificial Sequence
  Description of Artificial Sequence: Synthetic polypeptide
LIDSCEPTQVKHMMQVIEPQFQRDFISLLPKELALYVLSF

SEQ ID NO: 6202 - protein, 40 aa, Artificial Sequence
  Description of Artificial Sequence: Synthetic polypeptide
CRYWRILAEDNLLWREKCKEEGIDEPLHIKRRKVIKPGFI

SEQ ID NO: 6203 - protein, 40 aa, Artificial Sequence
  Description of Artificial Sequence: Synthetic polypeptide
YWRILAEDNLLWREKCKEEGIDEPLHIKRRKVIKPGFIHS

SEQ ID NO: 6204 - protein, 40 aa, Artificial Sequence
  Description of Artificial Sequence: Synthetic polypeptide
RILAEDNLLWREKCKEEGIDEPLHIKRRKVIKPGFIHSPW

SEQ ID NO: 6205 - protein, 40 aa, Artificial Sequence
  Description of Artificial Sequence: Synthetic polypeptide
ILAEDNLLWREKCKEEGIDEPLHIKRRKVIKPGFIHSPWK

SEQ ID NO: 6206 - protein, 40 aa, Artificial Sequence
  Description of Artificial Sequence: Synthetic polypeptide
LLWREKCKEEGIDEPLHIKRRKVIKPGFIHSPWKSAYIRQ

SEQ ID NO: 6207 - protein, 40 aa, Artificial Sequence
  Description of Artificial Sequence: Synthetic polypeptide
WREKCKEEGIDEPLHIKRRKVIKPGFIHSPWKSAYIRQHR

SEQ ID NO: 6208 - protein, 40 aa, Artificial Sequence
  Description of Artificial Sequence: Synthetic polypeptide
KCKEEGIDEPLHIKRRKVIKPGFIHSPWKSAYIRQHRIDT

SEQ ID NO: 6209 - protein, 40 aa, Artificial Sequence
  Description of Artificial Sequence: Synthetic polypeptide
PLHIKRRKVIKPGFIHSPWKSAYIRQHRIDTNWRRGELKS

SEQ ID NO: 6210 - protein, 40 aa, Artificial Sequence
  Description of Artificial Sequence: Synthetic polypeptide
RIDTNWRRGELKSPKVLKGHDDHVITCLQFCGNRIVSGSD

SEQ ID NO: 6211 - protein, 40 aa, Artificial Sequence
  Description of Artificial Sequence: Synthetic polypeptide
RRGELKSPKVLKGHDDHVITCLQFCGNRIVSGSDDNTLKV

SEQ ID NO: 6212 - protein, 40 aa, Artificial Sequence
  Description of Artificial Sequence: Synthetic polypeptide
GELKSPKVLKGHDDHVITCLQFCGNRIVSGSDDNTLKVWS

SEQ ID NO: 6213 - protein, 40 aa, Artificial Sequence
  Description of Artificial Sequence: Synthetic polypeptide
KSPKVLKGHDDHVITCLQFCGNRIVSGSDDNTLKVWSAVT

SEQ ID NO: 6214 - protein, 40 aa, Artificial Sequence
  Description of Artificial Sequence: Synthetic polypeptide
KVLKGHDDHVITCLQFCGNRIVSGSDDNTLKVWSAVTGKC

SEQ ID NO: 6215 - protein, 40 aa, Artificial Sequence
  Description of Artificial Sequence: Synthetic polypeptide
KGHDDHVITCLQFCGNRIVSGSDDNTLKVWSAVTGKCLRT

SEQ ID NO: 6216 - protein, 40 aa, Artificial Sequence
  Description of Artificial Sequence: Synthetic polypeptide
GHDDHVITCLQFCGNRIVSGSDDNTLKVWSAVTGKCLRTL

SEQ ID NO: 6217 - protein, 40 aa, Artificial Sequence
  Description of Artificial Sequence: Synthetic polypeptide
NRIVSGSDDNTLKVWSAVTGKCLRTLVGHTGGVWSSQMRD

SEQ ID NO: 6218 - protein, 40 aa, Artificial Sequence
  Description of Artificial Sequence: Synthetic polypeptide
RIVSGSDDNTLKVWSAVTGKCLRTLVGHTGGVWSSQMRDN

SEQ ID NO: 6219 - protein, 40 aa, Artificial Sequence
  Description of Artificial Sequence: Synthetic polypeptide
TLKVWSAVTGKCLRTLVGHTGGVWSSQMRDNIIISGSTDR

SEQ ID NO: 6220 - protein, 40 aa, Artificial Sequence
  Description of Artificial Sequence: Synthetic polypeptide
IISGSTDRTLKVWNAETGECIHTLYGHTSTVRCMHLHEKR

SEQ ID NO: 6221 - protein, 40 aa, Artificial Sequence
  Description of Artificial Sequence: Synthetic polypeptide
HTLYGHTSTVRCMHLHEKRVVSGSRDATLRVWDIETGQCL

SEQ ID NO: 6222 - protein, 40 aa, Artificial Sequence
  Description of Artificial Sequence: Synthetic polypeptide
YGHTSTVRCMHLHEKRVVSGSRDATLRVWDIETGQCLHVL

SEQ ID NO: 6223 - protein, 40 aa, Artificial Sequence
  Description of Artificial Sequence: Synthetic polypeptide
TSTVRCMHLHEKRVVSGSRDATLRVWDIETGQCLHVLMGH

SEQ ID NO: 6224 - protein, 40 aa, Artificial Sequence
  Description of Artificial Sequence: Synthetic polypeptide
TVRCMHLHEKRVVSGSRDATLRVWDIETGQCLHVLMGHVA

SEQ ID NO: 6225 - protein, 40 aa, Artificial Sequence
  Description of Artificial Sequence: Synthetic polypeptide
VRCMHLHEKRVVSGSRDATLRVWDIETGQCLHVLMGHVAA

SEQ ID NO: 6226 - protein, 40 aa, Artificial Sequence
  Description of Artificial Sequence: Synthetic polypeptide
GSRDATLRVWDIETGQCLHVLMGHVAAVRCVQYDGRRVVS

SEQ ID NO: 6227 - protein, 40 aa, Artificial Sequence
  Description of Artificial Sequence: Synthetic polypeptide
DIETGQCLHVLMGHVAAVRCVQYDGRRVVSGAYDFMVKVW

SEQ ID NO: 6228 - protein, 40 aa, Artificial Sequence
  Description of Artificial Sequence: Synthetic polypeptide
CLHVLMGHVAAVRCVQYDGRRVVSGAYDFMVKVWDPETET

SEQ ID NO: 6229 - protein, 40 aa, Artificial Sequence
  Description of Artificial Sequence: Synthetic polypeptide
LHVLMGHVAAVRCVQYDGRRVVSGAYDFMVKVWDPETETC

SEQ ID NO: 6230 - protein, 40 aa, Artificial Sequence
  Description of Artificial Sequence: Synthetic polypeptide
VAAVRCVQYDGRRVVSGAYDFMVKVWDPETETCLHTLQGH

SEQ ID NO: 6231 - protein, 40 aa, Artificial Sequence
  Description of Artificial Sequence: Synthetic polypeptide
QYDGRRVVSGAYDFMVKVWDPETETCLHTLQGHTNRVYSL

SEQ ID NO: 6232 - protein, 40 aa, Artificial Sequence
  Description of Artificial Sequence: Synthetic polypeptide
DGRRVVSGAYDFMVKVWDPETETCLHTLQGHTNRVYSLQF

SEQ ID NO: 6233 - protein, 40 aa, Artificial Sequence
  Description of Artificial Sequence: Synthetic polypeptide
GRRVVSGAYDFMVKVWDPETETCLHTLQGHTNRVYSLQFD

SEQ ID NO: 6234 - protein, 40 aa, Artificial Sequence
  Description of Artificial Sequence: Synthetic polypeptide
RRVVSGAYDFMVKVWDPETETCLHTLQGHTNRVYSLQFDG

SEQ ID NO: 6235 - protein, 40 aa, Artificial Sequence
  Description of Artificial Sequence: Synthetic polypeptide
RVVSGAYDFMVKVWDPETETCLHTLQGHTNRVYSLQFDGI

SEQ ID NO: 6236 - protein, 40 aa, Artificial Sequence
  Description of Artificial Sequence: Synthetic polypeptide
SGAYDFMVKVWDPETETCLHTLQGHTNRVYSLQFDGIHVV

SEQ ID NO: 6237 - protein, 40 aa, Artificial Sequence
  Description of Artificial Sequence: Synthetic polypeptide
GAYDFMVKVWDPETETCLHTLQGHTNRVYSLQFDGIHVVS

SEQ ID NO: 6238 - protein, 40 aa, Artificial Sequence
  Description of Artificial Sequence: Synthetic polypeptide
AYDFMVKVWDPETETCLHTLQGHTNRVYSLQFDGIHVVSG

SEQ ID NO: 6239 - protein, 40 aa, Artificial Sequence
  Description of Artificial Sequence: Synthetic polypeptide
FMVKVWDPETETCLHTLQGHTNRVYSLQFDGIHVVSGSLD

SEQ ID NO: 6240 - protein, 40 aa, Artificial Sequence
  Description of Artificial Sequence: Synthetic polypeptide
MVKVWDPETETCLHTLQGHTNRVYSLQFDGIHVVSGSLDT

SEQ ID NO: 6241 - protein, 40 aa, Artificial Sequence
  Description of Artificial Sequence: Synthetic polypeptide
VWDPETETCLHTLQGHTNRVYSLQFDGIHVVSGSLDTSIR

SEQ ID NO: 6242 - protein, 40 aa, Artificial Sequence
  Description of Artificial Sequence: Synthetic polypeptide
ETETCLHTLQGHTNRVYSLQFDGIHVVSGSLDTSIRVWDV

SEQ ID NO: 6243 - protein, 40 aa, Artificial Sequence
  Description of Artificial Sequence: Synthetic polypeptide
TLQGHTNRVYSLQFDGIHVVSGSLDTSIRVWDVETGNCIH

SEQ ID NO: 6244 - protein, 40 aa, Artificial Sequence
  Description of Artificial Sequence: Synthetic polypeptide
QGHTNRVYSLQFDGIHVVSGSLDTSIRVWDVETGNCIHTL

SEQ ID NO: 6245 - protein, 40 aa, Artificial Sequence
  Description of Artificial Sequence: Synthetic polypeptide
GHTNRVYSLQFDGIHVVSGSLDTSIRVWDVETGNCIHTLT

SEQ ID NO: 6246 - protein, 40 aa, Artificial Sequence
  Description of Artificial Sequence: Synthetic polypeptide
RVYSLQFDGIHVVSGSLDTSIRVWDVETGNCIHTLTGHQS

SEQ ID NO: 6247 - protein, 40 aa, Artificial Sequence
  Description of Artificial Sequence: Synthetic polypeptide
VYSLQFDGIHVVSGSLDTSIRVWDVETGNCIHTLTGHQSL

SEQ ID NO: 6248 - protein, 40 aa, Artificial Sequence
  Description of Artificial Sequence: Synthetic polypeptide
YSLQFDGIHVVSGSLDTSIRVWDVETGNCIHTLTGHQSLT

SEQ ID NO: 6249 - protein, 40 aa, Artificial Sequence
  Description of Artificial Sequence: Synthetic polypeptide
HTLTGHQSLTSGMELKDNILVSGNADSTVKIWDIKTGQCL

SEQ ID NO: 6250 - protein, 40 aa, Artificial Sequence
  Description of Artificial Sequence: Synthetic polypeptide
DNILVSGNADSTVKIWDIKTGQCLQTLQGPNKHQSAVTCL

SEQ ID NO: 6251 - protein, 40 aa, Artificial Sequence
  Description of Artificial Sequence: Synthetic polypeptide
QGPNKHQSAVTCLQFNKNFVITSSDDGTVKLWDLKTGEFI

SEQ ID NO: 6252 - protein, 40 aa, Artificial Sequence
  Description of Artificial Sequence: Synthetic polypeptide
RTVLIGEYLQIKGATPRDSGLYACTASRTVDSETWYFMVN

SEQ ID NO: 6253 - protein, 40 aa, Artificial Sequence
  Description of Artificial Sequence: Synthetic polypeptide
TVKFRCPAGGNPMPTMRWLKNGKEFKQEHRIGGYKVRNQH

SEQ ID NO: 6254 - protein, 40 aa, Artificial Sequence
  Description of Artificial Sequence: Synthetic polypeptide
VKFRCPAGGNPMPTMRWLKNGKEFKQEHRIGGYKVRNQHW

SEQ ID NO: 6255 - protein, 40 aa, Artificial Sequence
  Description of Artificial Sequence: Synthetic polypeptide
KFRCPAGGNPMPTMRWLKNGKEFKQEHRIGGYKVRNQHWS

SEQ ID NO: 6256 - protein, 40 aa, Artificial Sequence
  Description of Artificial Sequence: Synthetic polypeptide
FRCPAGGNPMPTMRWLKNGKEFKQEHRIGGYKVRNQHWSL

SEQ ID NO: 6257 - protein, 40 aa, Artificial Sequence
  Description of Artificial Sequence: Synthetic polypeptide
CPAGGNPMPTMRWLKNGKEFKQEHRIGGYKVRNQHWSLIM

SEQ ID NO: 6258 - protein, 40 aa, Artificial Sequence
  Description of Artificial Sequence: Synthetic polypeptide
NPMPTMRWLKNGKEFKQEHRIGGYKVRNQHWSLIMESVVP

SEQ ID NO: 6259 - protein, 40 aa, Artificial Sequence
  Description of Artificial Sequence: Synthetic polypeptide
MPTMRWLKNGKEFKQEHRIGGYKVRNQHWSLIMESVVPSD

SEQ ID NO: 6260 - protein, 40 aa, Artificial Sequence
  Description of Artificial Sequence: Synthetic polypeptide
MRWLKNGKEFKQEHRIGGYKVRNQHWSLIMESVVPSDKGN

SEQ ID NO: 6261 - protein, 40 aa, Artificial Sequence
  Description of Artificial Sequence: Synthetic polypeptide
KNGKEFKQEHRIGGYKVRNQHWSLIMESVVPSDKGNYTCV

SEQ ID NO: 6262 - protein, 40 aa, Artificial Sequence
  Description of Artificial Sequence: Synthetic polypeptide
KEFKQEHRIGGYKVRNQHWSLIMESVVPSDKGNYTCVVEN

SEQ ID NO: 6263 - protein, 40 aa, Artificial Sequence
  Description of Artificial Sequence: Synthetic polypeptide
FKQEHRIGGYKVRNQHWSLIMESVVPSDKGNYTCVVENEY

SEQ ID NO: 6264 - protein, 40 aa, Artificial Sequence
  Description of Artificial Sequence: Synthetic polypeptide
KQEHRIGGYKVRNQHWSLIMESVVPSDKGNYTCVVENEYG

SEQ ID NO: 6265 - protein, 40 aa, Artificial Sequence
  Description of Artificial Sequence: Synthetic polypeptide
QEHRIGGYKVRNQHWSLIMESVVPSDKGNYTCVVENEYGS

SEQ ID NO: 6266 - protein, 40 aa, Artificial Sequence
  Description of Artificial Sequence: Synthetic polypeptide
VRNQHWSLIMESVVPSDKGNYTCVVENEYGSINHTYHLDV

SEQ ID NO: 6267 - protein, 40 aa, Artificial Sequence
  Description of Artificial Sequence: Synthetic polypeptide
GPDGLPYLKVLKHSGINSSNAEVLALFNVTEADAGEYICK

SEQ ID NO: 6268 - protein, 40 aa, Artificial Sequence
  Description of Artificial Sequence: Synthetic polypeptide
DGLPYLKVLKHSGINSSNAEVLALFNVTEADAGEYICKVS

SEQ ID NO: 6269 - protein, 40 aa, Artificial Sequence
  Description of Artificial Sequence: Synthetic polypeptide
MPYLKVLKHSGINSSNAEVLALFNVTEADAGEYICKVSNY

SEQ ID NO: 6270 - protein, 40 aa, Artificial Sequence
  Description of Artificial Sequence: Synthetic polypeptide
HSGINSSNAEVLALFNVTEADAGEYICKVSNYIGQANQSA

SEQ ID NO: 6271 - protein, 40 aa, Artificial Sequence
  Description of Artificial Sequence: Synthetic polypeptide
GINSSNAEVLALFNVTEADAGEYICKVSNYIGQANQSAWL

SEQ ID NO: 6272 - protein, 40 aa, Artificial Sequence
  Description of Artificial Sequence: Synthetic polypeptide
VLALFNVTEADAGEYICKVSNYIGQANQSAWLTVLPKQQA

SEQ ID NO: 6273 - protein, 40 aa, Artificial Sequence
  Description of Artificial Sequence: Synthetic polypeptide
VTEADAGEYICKVSNYIGQANQSAWLTVLPKQQAPGREKE

SEQ ID NO: 6274 - protein, 40 aa, Artificial Sequence
  Description of Artificial Sequence: Synthetic polypeptide
EADAGEYICKVSNYIGQANQSAWLTVLPKQQAPGREKEIT

SEQ ID NO: 6275 - protein, 40 aa, Artificial Sequence
  Description of Artificial Sequence: Synthetic polypeptide
ADAGEYICKVSNYIGQANQSAWLTVLPKQQAPGREKEITA

SEQ ID NO: 6276 - protein, 40 aa, Artificial Sequence
  Description of Artificial Sequence: Synthetic polypeptide
DAGEYICKVSNYIGQANQSAWLTVLPKQQAPGREKEITAS

SEQ ID NO: 6277 - protein, 40 aa, Artificial Sequence
  Description of Artificial Sequence: Synthetic polypeptide
KVSNYIGQANQSAWLTVLPKQQAPGREKEITASPDYLEIA

SEQ ID NO: 6278 - protein, 40 aa, Artificial Sequence
  Description of Artificial Sequence: Synthetic polypeptide
VSNYIGQANQSAWLTVLPKQQAPGREKEITASPDYLEIAI

SEQ ID NO: 6279 - protein, 40 aa, Artificial Sequence
  Description of Artificial Sequence: Synthetic polypeptide
NYIGQANQSAWLTVLPKQQAPGREKEITASPDYLEIAIYC

SEQ ID NO: 6280 - protein, 40 aa, Artificial Sequence
  Description of Artificial Sequence: Synthetic polypeptide
YIGQANQSAWLTVLPKQQAPGREKEITASPDYLEIAIYCI

SEQ ID NO: 6281 - protein, 40 aa, Artificial Sequence
  Description of Artificial Sequence: Synthetic polypeptide
IGQANQSAWLTVLPKQQAPGREKEITASPDYLEIAIYCIG

SEQ ID NO: 6282 - protein, 40 aa, Artificial Sequence
  Description of Artificial Sequence: Synthetic polypeptide
ANQSAWLTVLPKQQAPGREKEITASPDYLEIAIYCIGVFL

SEQ ID NO: 6283 - protein, 40 aa, Artificial Sequence
  Description of Artificial Sequence: Synthetic polypeptide
NQSAWLTVLPKQQAPGREKEITASPDYLEIAIYCIGVFLI

SEQ ID NO: 6284 - protein, 40 aa, Artificial Sequence
  Description of Artificial Sequence: Synthetic polypeptide
QSAWLTVLPKQQAPGREKEITASPDYLEIAIYCIGVFLIA

SEQ ID NO: 6285 - protein, 40 aa, Artificial Sequence
  Description of Artificial Sequence: Synthetic polypeptide
SAWLTVLPKQQAPGREKEITASPDYLEIAIYCIGVFLIAC

SEQ ID NO: 6286 - protein, 40 aa, Artificial Sequence
  Description of Artificial Sequence: Synthetic polypeptide
WLTVLPKQQAPGREKEITASPDYLEIAIYCIGVFLIACMV

SEQ ID NO: 6287 - protein, 40 aa, Artificial Sequence
  Description of Artificial Sequence: Synthetic polypeptide
CIGVFLIACMVVTVILCRMKNTTKKPDFSSQPAVHKLTKR

SEQ ID NO: 6288 - protein, 40 aa, Artificial Sequence
  Description of Artificial Sequence: Synthetic polypeptide
CMVVTVILCRMKNTTKKPDFSSQPAVHKLTKRIPLRRQVT

SEQ ID NO: 6289 - protein, 40 aa, Artificial Sequence
  Description of Artificial Sequence: Synthetic polypeptide
TVILCRMKNTTKKPDFSSQPAVHKLTKRIPLRRQVTVSAE

SEQ ID NO: 6290 - protein, 40 aa, Artificial Sequence
  Description of Artificial Sequence: Synthetic polypeptide
VILCRMKNTTKKPDFSSQPAVHKLTKRIPLRRQVTVSAES

SEQ ID NO: 6291 - protein, 40 aa, Artificial Sequence
  Description of Artificial Sequence: Synthetic polypeptide
ILCRMKNTTKKPDFSSQPAVHKLTKRIPLRRQVTVSAESS

SEQ ID NO: 6292 - protein, 40 aa, Artificial Sequence
  Description of Artificial Sequence: Synthetic polypeptide
RMKNTTKKPDFSSQPAVHKLTKRIPLRRQVTVSAESSSSM

SEQ ID NO: 6293 - protein, 40 aa, Artificial Sequence
  Description of Artificial Sequence: Synthetic polypeptide
MKNTTKKPDFSSQPAVHKLTKRIPLRRQVTVSAESSSSMN

SEQ ID NO: 6294 - protein, 40 aa, Artificial Sequence
  Description of Artificial Sequence: Synthetic polypeptide
KNTTKKPDFSSQPAVHKLTKRIPLRRQVTVSAESSSSMNS

SEQ ID NO: 6295 - protein, 40 aa, Artificial Sequence
  Description of Artificial Sequence: Synthetic polypeptide
NTTKKPDFSSQPAVHKLTKRIPLRRQVTVSAESSSSMNSN

SEQ ID NO: 6296 - protein, 40 aa, Artificial Sequence
  Description of Artificial Sequence: Synthetic polypeptide
KKPDFSSQPAVHKLTKRIPLRRQVTVSAESSSSMNSNTPL

SEQ ID NO: 6297 - protein, 40 aa, Artificial Sequence
  Description of Artificial Sequence: Synthetic polypeptide
SSQPAVHKLTKRIPLRRQVTVSAESSSSMNSNTPLVRITT

SEQ ID NO: 6298 - protein, 40 aa, Artificial Sequence
  Description of Artificial Sequence: Synthetic polypeptide
PKEAVTVAVKMLKDDATEKDLSDLVSEMEMMKMIGKHKNI

SEQ ID NO: 6299 - protein, 40 aa, Artificial Sequence
  Description of Artificial Sequence: Synthetic polypeptide
KEAVTVAVKMLKDDATEKDLSDLVSEMEMMKMIGKHKNII

SEQ ID NO: 6300 - protein, 40 aa, Artificial Sequence
  Description of Artificial Sequence: Synthetic polypeptide
AVKMLKDDATEKDLSDLVSEMEMMKMIGKHKNIINLLGAC

SEQ ID NO: 6301 - protein, 40 aa, Artificial Sequence
  Description of Artificial Sequence: Synthetic polypeptide
VKMLKDDATEKDLSDLVSEMEMMKMIGKHKNIINLLGACT

SEQ ID NO: 6302 - protein, 40 aa, Artificial Sequence
  Description of Artificial Sequence: Synthetic polypeptide
MEMMKMIGKHKNIINLLGACTQDGPLYVIVEYASKGNLRE

SEQ ID NO: 6303 - protein, 40 aa, Artificial Sequence
  Description of Artificial Sequence: Synthetic polypeptide
EMMKMIGKHKNIINLLGACTQDGPLYVIVEYASKGNLREY

SEQ ID NO: 6304 - protein, 40 aa, Artificial Sequence
  Description of Artificial Sequence: Synthetic polypeptide
KHKNIINLLGACTQDGPLYVIVEYASKGNLREYLRARRPP

SEQ ID NO: 6305 - protein, 40 aa, Artificial Sequence
  Description of Artificial Sequence: Synthetic polypeptide
ARGMEYLASQKCIHRDLAARNVLVTENNVMKIADFGLARD

SEQ ID NO: 6306 - protein, 40 aa, Artificial Sequence
  Description of Artificial Sequence: Synthetic polypeptide
RGMEYLASQKCIHRDLAARNVLVTENNVMKIADFGLARDI

SEQ ID NO: 6307 - protein, 40 aa, Artificial Sequence
  Description of Artificial Sequence: Synthetic polypeptide
ASQKCIHRDLAARNVLVTENNVMKIADFGLARDINNIDYY

SEQ ID NO: 6308 - protein, 40 aa, Artificial Sequence
  Description of Artificial Sequence: Synthetic polypeptide
KCIHRDLAARNVLVTENNVMKIADFGLARDINNIDYYKKT

SEQ ID NO: 6309 - protein, 40 aa, Artificial Sequence
  Description of Artificial Sequence: Synthetic polypeptide
MFDRVYTHQSDVWSFGVLMWEIFTLGGSPYPGIPVEELFK

SEQ ID NO: 6310 - protein, 40 aa, Artificial Sequence
  Description of Artificial Sequence: Synthetic polypeptide
TLGGSPYPGIPVEELFKLLKEGHRMDKPANCTNELYMMMR

SEQ ID NO: 6311 - protein, 40 aa, Artificial Sequence
  Description of Artificial Sequence: Synthetic polypeptide
MGAPACALALCVAVAIVAGASSESLGTEQRVVGRAAEVPG

SEQ ID NO: 6312 - protein, 40 aa, Artificial Sequence
  Description of Artificial Sequence: Synthetic polypeptide
GGPMGPTVWVKDGTGLVPSERVLVGPQRLQVLNASHEDSG

SEQ ID NO: 6313 - protein, 40 aa, Artificial Sequence
  Description of Artificial Sequence: Synthetic polypeptide
PSERVLVGPQRLQVLNASHEDSGAYSCRQRLTQRVLCHFS

SEQ ID NO: 6314 - protein, 40 aa, Artificial Sequence
  Description of Artificial Sequence: Synthetic polypeptide
MVGPQRLQVLNASHEDSGAYSCRQRLTQRVLCHFSVRVTD

SEQ ID NO: 6315 - protein, 40 aa, Artificial Sequence
  Description of Artificial Sequence: Synthetic polypeptide
TRPERMDKKLLAVPAANTVRFRCPAAGNPTPSISWLKNGR

SEQ ID NO: 6316 - protein, 40 aa, Artificial Sequence
  Description of Artificial Sequence: Synthetic polypeptide
TLDVLERSPHRPILQAGLPANQTAVLGSDVEFHCKVYSDA

SEQ ID NO: 6317 - protein, 40 aa, Artificial Sequence
  Description of Artificial Sequence: Synthetic polypeptide
LKHVEVNGSKVGPDGTPYVTVLKTAGANTTDKELEVLSLH

SEQ ID NO: 6318 - protein, 40 aa, Artificial Sequence
  Description of Artificial Sequence: Synthetic polypeptide
PADPKWELSRARLTLGKPLGEGCFGQVVMAEAIGIDKDRA

SEQ ID NO: 6319 - protein, 40 aa, Artificial Sequence
  Description of Artificial Sequence: Synthetic polypeptide
AIGIDKDRAAKPVTVAVKMLKDDATDKDLSDLVSEMEMMK

SEQ ID NO: 6320 - protein, 40 aa, Artificial Sequence
  Description of Artificial Sequence: Synthetic polypeptide
MSDLVSEMEMMKMIGKHKNIINLLGACTQGGPLYVLVEYA

SEQ ID NO: 6321 - protein, 40 aa, Artificial Sequence
  Description of Artificial Sequence: Synthetic polypeptide
NIINLLGACTQGGPLYVLVEYAAKGNLREFLRARRPPGLD

SEQ ID NO: 6322 - protein, 40 aa, Artificial Sequence
  Description of Artificial Sequence: Synthetic polypeptide
ACTQGGPLYVLVEYAAKGNLREFLRARRPPGLDYSFDTCK

SEQ ID NO: 6323 - protein, 40 aa, Artificial Sequence
  Description of Artificial Sequence: Synthetic polypeptide
QKCIHRDLAARNVLVTEDNVMKIADFGLARDVHNLDYYKK

SEQ ID NO: 6324 - protein, 40 aa, Artificial Sequence
  Description of Artificial Sequence: Synthetic polypeptide
MPALARDGGQLPLLVVFSAMIFGTITNQDLPVIKCVLINH

SEQ ID NO: 6325 - protein, 40 aa, Artificial Sequence
  Description of Artificial Sequence: Synthetic polypeptide
PALARDGGQLPLLVVFSAMIFGTITNQDLPVIKCVLINHK

SEQ ID NO: 6326 - protein, 40 aa, Artificial Sequence
  Description of Artificial Sequence: Synthetic polypeptide
ALARDGGQLPLLVVFSAMIFGTITNQDLPVIKCVLINHKN

SEQ ID NO: 6327 - protein, 40 aa, Artificial Sequence
  Description of Artificial Sequence: Synthetic polypeptide
MARDGGQLPLLVVFSAMIFGTITNQDLPVIKCVLINHKNN

SEQ ID NO: 6328 - protein, 40 aa, Artificial Sequence
  Description of Artificial Sequence: Synthetic polypeptide
QVLVDAPGNISCLWVFKHSSLNCQPHFDLQNRGVVSMVIL

SEQ ID NO: 6329 - protein, 40 aa, Artificial Sequence
  Description of Artificial Sequence: Synthetic polypeptide
VLVDAPGNISCLWVFKHSSLNCQPHFDLQNRGVVSMVILK

SEQ ID NO: 6330 - protein, 40 aa, Artificial Sequence
  Description of Artificial Sequence: Synthetic polypeptide
HFDLQNRGVVSMVILKMTETQAGEYLLFIQSEATNYTILF

SEQ ID NO: 6331 - protein, 40 aa, Artificial Sequence
  Description of Artificial Sequence: Synthetic polypeptide
DLQNRGVVSMVILKMTETQAGEYLLFIQSEATNYTILFTV

SEQ ID NO: 6332 - protein, 40 aa, Artificial Sequence
  Description of Artificial Sequence: Synthetic polypeptide
QNRGVVSMVILKMTETQAGEYLLFIQSEATNYTILFTVSI

SEQ ID NO: 6333 - protein, 40 aa, Artificial Sequence
  Description of Artificial Sequence: Synthetic polypeptide
GVVSMVILKMTETQAGEYLLFIQSEATNYTILFTVSIRNT

SEQ ID NO: 6334 - protein, 40 aa, Artificial Sequence
  Description of Artificial Sequence: Synthetic polypeptide
VVSMVILKMTETQAGEYLLFIQSEATNYTILFTVSIRNTL

SEQ ID NO: 6335 - protein, 40 aa, Artificial Sequence
  Description of Artificial Sequence: Synthetic polypeptide
VSMVILKMTETQAGEYLLFIQSEATNYTILFTVSIRNTLL

SEQ ID NO: 6336 - protein, 40 aa, Artificial Sequence
  Description of Artificial Sequence: Synthetic polypeptide
SMVILKMTETQAGEYLLFIQSEATNYTILFTVSIRNTLLY

SEQ ID NO: 6337 - protein, 40 aa, Artificial Sequence
  Description of Artificial Sequence: Synthetic polypeptide
MKMTETQAGEYLLFIQSEATNYTILFTVSIRNTLLYTLRR

SEQ ID NO: 6338 - protein, 40 aa, Artificial Sequence
  Description of Artificial Sequence: Synthetic polypeptide
AGEYLLFIQSEATNYTILFTVSIRNTLLYTLRRPYFRKME

SEQ ID NO: 6339 - protein, 40 aa, Artificial Sequence
  Description of Artificial Sequence: Synthetic polypeptide
MLYTLRRPYFRKMENQDALVCISESVPEPIVEWVLCDSQG

SEQ ID NO: 6340 - protein, 40 aa, Artificial Sequence
  Description of Artificial Sequence: Synthetic polypeptide
YTLRRPYFRKMENQDALVCISESVPEPIVEWVLCDSQGES

SEQ ID NO: 6341 - protein, 40 aa, Artificial Sequence
  Description of Artificial Sequence: Synthetic polypeptide
LRRPYFRKMENQDALVCISESVPEPIVEWVLCDSQGESCK

SEQ ID NO: 6342 - protein, 40 aa, Artificial Sequence
  Description of Artificial Sequence: Synthetic polypeptide
RRPYFRKMENQDALVCISESVPEPIVEWVLCDSQGESCKE

SEQ ID NO: 6343 - protein, 40 aa, Artificial Sequence
  Description of Artificial Sequence: Synthetic polypeptide
RPYFRKMENQDALVCISESVPEPIVEWVLCDSQGESCKEE

SEQ ID NO: 6344 - protein, 40 aa, Artificial Sequence
  Description of Artificial Sequence: Synthetic polypeptide
PYFRKMENQDALVCISESVPEPIVEWVLCDSQGESCKEES

SEQ ID NO: 6345 - protein, 40 aa, Artificial Sequence
  Description of Artificial Sequence: Synthetic polypeptide
NQDALVCISESVPEPIVEWVLCDSQGESCKEESPAVVKKE

SEQ ID NO: 6346 - protein, 40 aa, Artificial Sequence
  Description of Artificial Sequence: Synthetic polypeptide
MVCISESVPEPIVEWVLCDSQGESCKEESPAVVKKEEKVL

SEQ ID NO: 6347 - protein, 40 aa, Artificial Sequence
  Description of Artificial Sequence: Synthetic polypeptide
ISESVPEPIVEWVLCDSQGESCKEESPAVVKKEEKVLHEL

SEQ ID NO: 6348 - protein, 40 aa, Artificial Sequence
  Description of Artificial Sequence: Synthetic polypeptide
ESVPEPIVEWVLCDSQGESCKEESPAVVKKEEKVLHELFG

SEQ ID NO: 6349 - protein, 40 aa, Artificial Sequence
  Description of Artificial Sequence: Synthetic polypeptide
ECTRLFTIDLNQTPQTTLPQLFLKVGEPLWIRCKAVHVNH

SEQ ID NO: 6350 - protein, 40 aa, Artificial Sequence
  Description of Artificial Sequence: Synthetic polypeptide
PQTTLPQLFLKVGEPLWIRCKAVHVNHGFGLTWELENKAL

SEQ ID NO: 6351 - protein, 40 aa, Artificial Sequence
  Description of Artificial Sequence: Synthetic polypeptide
QLFLKVGEPLWIRCKAVHVNHGFGLTWELENKALEEGNYF

SEQ ID NO: 6352 - protein, 40 aa, Artificial Sequence
  Description of Artificial Sequence: Synthetic polypeptide
FLKVGEPLWIRCKAVHVNHGFGLTWELENKALEEGNYFEM

SEQ ID NO: 6353 - protein, 40 aa, Artificial Sequence
  Description of Artificial Sequence: Synthetic polypeptide
LKVGEPLWIRCKAVHVNHGFGLTWELENKALEEGNYFEMS

SEQ ID NO: 6354 - protein, 40 aa, Artificial Sequence
  Description of Artificial Sequence: Synthetic polypeptide
LWIRCKAVHVNHGFGLTWELENKALEEGNYFEMSTYSTNR

SEQ ID NO: 6355 - protein, 40 aa, Artificial Sequence
  Description of Artificial Sequence: Synthetic polypeptide
CKAVHVNHGFGLTWELENKALEEGNYFEMSTYSTNRTMIR

SEQ ID NO: 6356 - protein, 40 aa, Artificial Sequence
  Description of Artificial Sequence: Synthetic polypeptide
NSSEDYEIDQYEEFCFSVRFKAYPQIRCTWTFSRKSFPCE

SEQ ID NO: 6357 - protein, 40 aa, Artificial Sequence
  Description of Artificial Sequence: Synthetic polypeptide
DYEIDQYEEFCFSVRFKAYPQIRCTWTFSRKSFPCEQKGL

SEQ ID NO: 6358 - protein, 40 aa, Artificial Sequence
  Description of Artificial Sequence: Synthetic polypeptide
YEIDQYEEFCFSVRFKAYPQIRCTWTFSRKSFPCEQKGLD

SEQ ID NO: 6359 - protein, 40 aa, Artificial Sequence
  Description of Artificial Sequence: Synthetic polypeptide
EIDQYEEFCFSVRFKAYPQIRCTWTFSRKSFPCEQKGLDN

SEQ ID NO: 6360 - protein, 40 aa, Artificial Sequence
  Description of Artificial Sequence: Synthetic polypeptide
EFCFSVRFKAYPQIRCTWTFSRKSFPCEQKGLDNGYSISK

SEQ ID NO: 6361 - protein, 40 aa, Artificial Sequence
  Description of Artificial Sequence: Synthetic polypeptide
CFSVRFKAYPQIRCTWTFSRKSFPCEQKGLDNGYSISKFC

SEQ ID NO: 6362 - protein, 40 aa, Artificial Sequence
  Description of Artificial Sequence: Synthetic polypeptide
SVRFKAYPQIRCTWTFSRKSFPCEQKGLDNGYSISKFCNH

SEQ ID NO: 6363 - protein, 40 aa, Artificial Sequence
  Description of Artificial Sequence: Synthetic polypeptide
QIRCTWTFSRKSFPCEQKGLDNGYSISKFCNHKHQPGEYI

SEQ ID NO: 6364 - protein, 40 aa, Artificial Sequence
  Description of Artificial Sequence: Synthetic polypeptide
RCTWTFSRKSFPCEQKGLDNGYSISKFCNHKHQPGEYIFH

SEQ ID NO: 6365 - protein, 40 aa, Artificial Sequence
  Description of Artificial Sequence: Synthetic polypeptide
TWTFSRKSFPCEQKGLDNGYSISKFCNHKHQPGEYIFHAE

SEQ ID NO: 6366 - protein, 40 aa, Artificial Sequence
  Description of Artificial Sequence: Synthetic polypeptide
NHKHQPGEYIFHAENDDAQFTKMFTLNIRRKPQVLAEASA

SEQ ID NO: 6367 - protein, 40 aa, Artificial Sequence
  Description of Artificial Sequence: Synthetic polypeptide
PGEYIFHAENDDAQFTKMFTLNIRRKPQVLAEASASQASC

SEQ ID NO: 6368 - protein, 40 aa, Artificial Sequence
  Description of Artificial Sequence: Synthetic polypeptide
GEYIFHAENDDAQFTKMFTLNIRRKPQVLAEASASQASCF

SEQ ID NO: 6369 - protein, 40 aa, Artificial Sequence
  Description of Artificial Sequence: Synthetic polypeptide
EYIFHAENDDAQFTKMFTLNIRRKPQVLAEASASQASCFS

SEQ ID NO: 6370 - protein, 40 aa, Artificial Sequence
  Description of Artificial Sequence: Synthetic polypeptide
EASASQASCFSDGYPLPSWTWKKCSDKSPNCTEEITEGVW

SEQ ID NO: 6371 - protein, 40 aa, Artificial Sequence
  Description of Artificial Sequence: Synthetic polypeptide
CFSDGYPLPSWTWKKCSDKSPNCTEEITEGVWNRKANRKV

SEQ ID NO: 6372 - protein, 40 aa, Artificial Sequence
  Description of Artificial Sequence: Synthetic polypeptide
DGYPLPSWTWKKCSDKSPNCTEEITEGVWNRKANRKVFGQ

SEQ ID NO: 6373 - protein, 40 aa, Artificial Sequence
  Description of Artificial Sequence: Synthetic polypeptide
GYPLPSWTWKKCSDKSPNCTEEITEGVWNRKANRKVFGQW

SEQ ID NO: 6374 - protein, 40 aa, Artificial Sequence
  Description of Artificial Sequence: Synthetic polypeptide
WTWKKCSDKSPNCTEEITEGVWNRKANRKVFGQWVSSSTL

SEQ ID NO: 6375 - protein, 40 aa, Artificial Sequence
  Description of Artificial Sequence: Synthetic polypeptide
RKANRKVFGQWVSSSTLNMSEAIKGFLVKCCAYNSLGTSC

SEQ ID NO: 6376 - protein, 40 aa, Artificial Sequence
  Description of Artificial Sequence: Synthetic polypeptide
SSTLNMSEAIKGFLVKCCAYNSLGTSCETILLNSPGPFPF

SEQ ID NO: 6377 - protein, 40 aa, Artificial Sequence
  Description of Artificial Sequence: Synthetic polypeptide
STLNMSEAIKGFLVKCCAYNSLGTSCETILLNSPGPFPFI

SEQ ID NO: 6378 - protein, 40 aa, Artificial Sequence
  Description of Artificial Sequence: Synthetic polypeptide
TLNMSEAIKGFLVKCCAYNSLGTSCETILLNSPGPFPFIQ

SEQ ID NO: 6379 - protein, 40 aa, Artificial Sequence
  Description of Artificial Sequence: Synthetic polypeptide
LNMSEAIKGFLVKCCAYNSLGTSCETILLNSPGPFPFIQD

SEQ ID NO: 6380 - protein, 40 aa, Artificial Sequence
  Description of Artificial Sequence: Synthetic polypeptide
NMSEAIKGFLVKCCAYNSLGTSCETILLNSPGPFPFIQDN

SEQ ID NO: 6381 - protein, 40 aa, Artificial Sequence
  Description of Artificial Sequence: Synthetic polypeptide
MVKCCAYNSLGTSCETILLNSPGPFPFIQDNISFYATIGV

SEQ ID NO: 6382 - protein, 40 aa, Artificial Sequence
  Description of Artificial Sequence: Synthetic polypeptide
VKCCAYNSLGTSCETILLNSPGPFPFIQDNISFYATIGVC

SEQ ID NO: 6383 - protein, 40 aa, Artificial Sequence
  Description of Artificial Sequence: Synthetic polypeptide
CAYNSLGTSCETILLNSPGPFPFIQDNISFYATIGVCLLF

SEQ ID NO: 6384 - protein, 40 aa, Artificial Sequence
  Description of Artificial Sequence: Synthetic polypeptide
YNSLGTSCETILLNSPGPFPFIQDNISFYATIGVCLLFIV

SEQ ID NO: 6385 - protein, 40 aa, Artificial Sequence
  Description of Artificial Sequence: Synthetic polypeptide
SLGTSCETILLNSPGPFPFIQDNISFYATIGVCLLFIVVL

SEQ ID NO: 6386 - protein, 40 aa, Artificial Sequence
  Description of Artificial Sequence: Synthetic polypeptide
LGTSCETILLNSPGPFPFIQDNISFYATIGVCLLFIVVLT

SEQ ID NO: 6387 - protein, 40 aa, Artificial Sequence
  Description of Artificial Sequence: Synthetic polypeptide
GTSCETILLNSPGPFPFIQDNISFYATIGVCLLFIVVLTL

SEQ ID NO: 6388 - protein, 40 aa, Artificial Sequence
  Description of Artificial Sequence: Synthetic polypeptide
TSCETILLNSPGPFPFIQDNISFYATIGVCLLFIVVLTLL

SEQ ID NO: 6389 - protein, 40 aa, Artificial Sequence
  Description of Artificial Sequence: Synthetic polypeptide
SCETILLNSPGPFPFIQDNISFYATIGVCLLFIVVLTLLI

SEQ ID NO: 6390 - protein, 40 aa, Artificial Sequence
  Description of Artificial Sequence: Synthetic polypeptide
CETILLNSPGPFPFIQDNISFYATIGVCLLFIVVLTLLIC

SEQ ID NO: 6391 - protein, 40 aa, Artificial Sequence
  Description of Artificial Sequence: Synthetic polypeptide
ETILLNSPGPFPFIQDNISFYATIGVCLLFIVVLTLLICH

SEQ ID NO: 6392 - protein, 40 aa, Artificial Sequence
  Description of Artificial Sequence: Synthetic polypeptide
TILLNSPGPFPFIQDNISFYATIGVCLLFIVVLTLLICHK

SEQ ID NO: 6393 - protein, 40 aa, Artificial Sequence
  Description of Artificial Sequence: Synthetic polypeptide
ILLNSPGPFPFIQDNISFYATIGVCLLFIVVLTLLICHKY

SEQ ID NO: 6394 - protein, 40 aa, Artificial Sequence
  Description of Artificial Sequence: Synthetic polypeptide
LLNSPGPFPFIQDNISFYATIGVCLLFIVVLTLLICHKYK

SEQ ID NO: 6395 - protein, 40 aa, Artificial Sequence
  Description of Artificial Sequence: Synthetic polypeptide
SPGPFPFIQDNISFYATIGVCLLFIVVLTLLICHKYKKQF

SEQ ID NO: 6396 - protein, 40 aa, Artificial Sequence
  Description of Artificial Sequence: Synthetic polypeptide
GPFPFIQDNISFYATIGVCLLFIVVLTLLICHKYKKQFRY

SEQ ID NO: 6397 - protein, 40 aa, Artificial Sequence
  Description of Artificial Sequence: Synthetic polypeptide
PFIQDNISFYATIGVCLLFIVVLTLLICHKYKKQFRYESQ

SEQ ID NO: 6398 - protein, 40 aa, Artificial Sequence
  Description of Artificial Sequence: Synthetic polypeptide
QDNISFYATIGVCLLFIVVLTLLICHKYKKQFRYESQLQM

SEQ ID NO: 6399 - protein, 40 aa, Artificial Sequence
  Description of Artificial Sequence: Synthetic polypeptide
ISFYATIGVCLLFIVVLTLLICHKYKKQFRYESQLQMVQV

SEQ ID NO: 6400 - protein, 40 aa, Artificial Sequence
  Description of Artificial Sequence: Synthetic polypeptide
SFYATIGVCLLFIVVLTLLICHKYKKQFRYESQLQMVQVT

SEQ ID NO: 6401 - protein, 40 aa, Artificial Sequence
  Description of Artificial Sequence: Synthetic polypeptide
ATIGVCLLFIVVLTLLICHKYKKQFRYESQLQMVQVTGSS

SEQ ID NO: 6402 - protein, 40 aa, Artificial Sequence
  Description of Artificial Sequence: Synthetic polypeptide
TIGVCLLFIVVLTLLICHKYKKQFRYESQLQMVQVTGSSD

SEQ ID NO: 6403 - protein, 40 aa, Artificial Sequence
  Description of Artificial Sequence: Synthetic polypeptide
IGVCLLFIVVLTLLICHKYKKQFRYESQLQMVQVTGSSDN

SEQ ID NO: 6404 - protein, 40 aa, Artificial Sequence
  Description of Artificial Sequence: Synthetic polypeptide
GVCLLFIVVLTLLICHKYKKQFRYESQLQMVQVTGSSDNE

SEQ ID NO: 6405 - protein, 40 aa, Artificial Sequence
  Description of Artificial Sequence: Synthetic polypeptide
CLLFIVVLTLLICHKYKKQFRYESQLQMVQVTGSSDNEYF

SEQ ID NO: 6406 - protein, 40 aa, Artificial Sequence
  Description of Artificial Sequence: Synthetic polypeptide
LLFIVVLTLLICHKYKKQFRYESQLQMVQVTGSSDNEYFY

SEQ ID NO: 6407 - protein, 40 aa, Artificial Sequence
  Description of Artificial Sequence: Synthetic polypeptide
LFIVVLTLLICHKYKKQFRYESQLQMVQVTGSSDNEYFYV

SEQ ID NO: 6408 - protein, 40 aa, Artificial Sequence
  Description of Artificial Sequence: Synthetic polypeptide
FIVVLTLLICHKYKKQFRYESQLQMVQVTGSSDNEYFYVD

SEQ ID NO: 6409 - protein, 40 aa, Artificial Sequence
  Description of Artificial Sequence: Synthetic polypeptide
IVVLTLLICHKYKKQFRYESQLQMVQVTGSSDNEYFYVDF

SEQ ID NO: 6410 - protein, 40 aa, Artificial Sequence
  Description of Artificial Sequence: Synthetic polypeptide
VVLTLLICHKYKKQFRYESQLQMVQVTGSSDNEYFYVDFR

SEQ ID NO: 6411 - protein, 40 aa, Artificial Sequence
  Description of Artificial Sequence: Synthetic polypeptide
VLTLLICHKYKKQFRYESQLQMVQVTGSSDNEYFYVDFRE

SEQ ID NO: 6412 - protein, 40 aa, Artificial Sequence
  Description of Artificial Sequence: Synthetic polypeptide
LICHKYKKQFRYESQLQMVQVTGSSDNEYFYVDFREYEYD

SEQ ID NO: 6413 - protein, 40 aa, Artificial Sequence
  Description of Artificial Sequence: Synthetic polypeptide
HKYKKQFRYESQLQMVQVTGSSDNEYFYVDFREYEYDLKW

SEQ ID NO: 6414 - protein, 40 aa, Artificial Sequence
  Description of Artificial Sequence: Synthetic polypeptide
YKKQFRYESQLQMVQVTGSSDNEYFYVDFREYEYDLKWEF

SEQ ID NO: 6415 - protein, 40 aa, Artificial Sequence
  Description of Artificial Sequence: Synthetic polypeptide
FRYESQLQMVQVTGSSDNEYFYVDFREYEYDLKWEFPREN

SEQ ID NO: 6416 - protein, 40 aa, Artificial Sequence
  Description of Artificial Sequence: Synthetic polypeptide
RYESQLQMVQVTGSSDNEYFYVDFREYEYDLKWEFPRENL

SEQ ID NO: 6417 - protein, 40 aa, Artificial Sequence
  Description of Artificial Sequence: Synthetic polypeptide
YESQLQMVQVTGSSDNEYFYVDFREYEYDLKWEFPRENLE

SEQ ID NO: 6418 - protein, 40 aa, Artificial Sequence
  Description of Artificial Sequence: Synthetic polypeptide
ESQLQMVQVTGSSDNEYFYVDFREYEYDLKWEFPRENLEF

SEQ ID NO: 6419 - protein, 40 aa, Artificial Sequence
  Description of Artificial Sequence: Synthetic polypeptide
SQLQMVQVTGSSDNEYFYVDFREYEYDLKWEFPRENLEFG

SEQ ID NO: 6420 - protein, 40 aa, Artificial Sequence
  Description of Artificial Sequence: Synthetic polypeptide
QLQMVQVTGSSDNEYFYVDFREYEYDLKWEFPRENLEFGK

SEQ ID NO: 6421 - protein, 40 aa, Artificial Sequence
  Description of Artificial Sequence: Synthetic polypeptide
MVQVTGSSDNEYFYVDFREYEYDLKWEFPRENLEFGKVLG

SEQ ID NO: 6422 - protein, 40 aa, Artificial Sequence
  Description of Artificial Sequence: Synthetic polypeptide
VQVTGSSDNEYFYVDFREYEYDLKWEFPRENLEFGKVLGS

SEQ ID NO: 6423 - protein, 40 aa, Artificial Sequence
  Description of Artificial Sequence: Synthetic polypeptide
VTGSSDNEYFYVDFREYEYDLKWEFPRENLEFGKVLGSGA

SEQ ID NO: 6424 - protein, 40 aa, Artificial Sequence
  Description of Artificial Sequence: Synthetic polypeptide
TGSSDNEYFYVDFREYEYDLKWEFPRENLEFGKVLGSGAF

SEQ ID NO: 6425 - protein, 40 aa, Artificial Sequence
  Description of Artificial Sequence: Synthetic polypeptide
GSSDNEYFYVDFREYEYDLKWEFPRENLEFGKVLGSGAFG

SEQ ID NO: 6426 - protein, 40 aa, Artificial Sequence
  Description of Artificial Sequence: Synthetic polypeptide
SSDNEYFYVDFREYEYDLKWEFPRENLEFGKVLGSGAFGK

SEQ ID NO: 6427 - protein, 40 aa, Artificial Sequence
  Description of Artificial Sequence: Synthetic polypeptide
SDNEYFYVDFREYEYDLKWEFPRENLEFGKVLGSGAFGKV

SEQ ID NO: 6428 - protein, 40 aa, Artificial Sequence
  Description of Artificial Sequence: Synthetic polypeptide
DNEYFYVDFREYEYDLKWEFPRENLEFGKVLGSGAFGKVM

SEQ ID NO: 6429 - protein, 40 aa, Artificial Sequence
  Description of Artificial Sequence: Synthetic polypeptide
NEYFYVDFREYEYDLKWEFPRENLEFGKVLGSGAFGKVMN

SEQ ID NO: 6430 - protein, 40 aa, Artificial Sequence
  Description of Artificial Sequence: Synthetic polypeptide
DFREYEYDLKWEFPRENLEFGKVLGSGAFGKVMNATAYGI

SEQ ID NO: 6431 - protein, 40 aa, Artificial Sequence
  Description of Artificial Sequence: Synthetic polypeptide
FREYEYDLKWEFPRENLEFGKVLGSGAFGKVMNATAYGIS

SEQ ID NO: 6432 - protein, 40 aa, Artificial Sequence
  Description of Artificial Sequence: Synthetic polypeptide
DLKWEFPRENLEFGKVLGSGAFGKVMNATAYGISKTGVSI

SEQ ID NO: 6433 - protein, 40 aa, Artificial Sequence
  Description of Artificial Sequence: Synthetic polypeptide
EFPRENLEFGKVLGSGAFGKVMNATAYGISKTGVSIQVAV

SEQ ID NO: 6434 - protein, 40 aa, Artificial Sequence
  Description of Artificial Sequence: Synthetic polypeptide
FPRENLEFGKVLGSGAFGKVMNATAYGISKTGVSIQVAVK

SEQ ID NO: 6435 - protein, 40 aa, Artificial Sequence
  Description of Artificial Sequence: Synthetic polypeptide
RENLEFGKVLGSGAFGKVMNATAYGISKTGVSIQVAVKML

SEQ ID NO: 6436 - protein, 40 aa, Artificial Sequence
  Description of Artificial Sequence: Synthetic polypeptide
ENLEFGKVLGSGAFGKVMNATAYGISKTGVSIQVAVKMLK

SEQ ID NO: 6437 - protein, 40 aa, Artificial Sequence
  Description of Artificial Sequence: Synthetic polypeptide
LEFGKVLGSGAFGKVMNATAYGISKTGVSIQVAVKMLKEK

SEQ ID NO: 6438 - protein, 40 aa, Artificial Sequence
  Description of Artificial Sequence: Synthetic polypeptide
GSGAFGKVMNATAYGISKTGVSIQVAVKMLKEKADSSERE

SEQ ID NO: 6439 - protein, 40 aa, Artificial Sequence
  Description of Artificial Sequence: Synthetic polypeptide
GAFGKVMNATAYGISKTGVSIQVAVKMLKEKADSSEREAL

SEQ ID NO: 6440 - protein, 40 aa, Artificial Sequence
  Description of Artificial Sequence: Synthetic polypeptide
AFGKVMNATAYGISKTGVSIQVAVKMLKEKADSSEREALM

SEQ ID NO: 6441 - protein, 40 aa, Artificial Sequence
  Description of Artificial Sequence: Synthetic polypeptide
FGKVMNATAYGISKTGVSIQVAVKMLKEKADSSEREALMS

SEQ ID NO: 6442 - protein, 40 aa, Artificial Sequence
  Description of Artificial Sequence: Synthetic polypeptide
KVMNATAYGISKTGVSIQVAVKMLKEKADSSEREALMSEL

SEQ ID NO: 6443 - protein, 40 aa, Artificial Sequence
  Description of Artificial Sequence: Synthetic polypeptide
VMNATAYGISKTGVSIQVAVKMLKEKADSSEREALMSELK

SEQ ID NO: 6444 - protein, 40 aa, Artificial Sequence
  Description of Artificial Sequence: Synthetic polypeptide
GISKTGVSIQVAVKMLKEKADSSEREALMSELKMMTQLGS

SEQ ID NO: 6445 - protein, 40 aa, Artificial Sequence
  Description of Artificial Sequence: Synthetic polypeptide
KTGVSIQVAVKMLKEKADSSEREALMSELKMMTQLGSHEN

SEQ ID NO: 6446 - protein, 40 aa, Artificial Sequence
  Description of Artificial Sequence: Synthetic polypeptide
SELKMMTQLGSHENIVNLLGACTLSGPIYLIFEYCCYGDL

SEQ ID NO: 6447 - protein, 40 aa, Artificial Sequence
  Description of Artificial Sequence: Synthetic polypeptide
TQLGSHENIVNLLGACTLSGPIYLIFEYCCYGDLLNYLRS

SEQ ID NO: 6448 - protein, 40 aa, Artificial Sequence
  Description of Artificial Sequence: Synthetic polypeptide
IVNLLGACTLSGPIYLIFEYCCYGDLLNYLRSKREKFHRT

SEQ ID NO: 6449 - protein, 40 aa, Artificial Sequence
  Description of Artificial Sequence: Synthetic polypeptide
MGACTLSGPIYLIFEYCCYGDLLNYLRSKREKFHRTWTEI

SEQ ID NO: 6450 - protein, 40 aa, Artificial Sequence
  Description of Artificial Sequence: Synthetic polypeptide
GPIYLIFEYCCYGDLLNYLRSKREKFHRTWTEIFKEHNFS

SEQ ID NO: 6451 - protein, 40 aa, Artificial Sequence
  Description of Artificial Sequence: Synthetic polypeptide
PIYLIFEYCCYGDLLNYLRSKREKFHRTWTEIFKEHNFSF

SEQ ID NO: 6452 - protein, 40 aa, Artificial Sequence
  Description of Artificial Sequence: Synthetic polypeptide
CYGDLLNYLRSKREKFHRTWTEIFKEHNFSFYPTFQSHPN

SEQ ID NO: 6453 - protein, 40 aa, Artificial Sequence
  Description of Artificial Sequence: Synthetic polypeptide
YGDLLNYLRSKREKFHRTWTEIFKEHNFSFYPTFQSHPNS

SEQ ID NO: 6454 - protein, 40 aa, Artificial Sequence
  Description of Artificial Sequence: Synthetic polypeptide
SREVQIHPDSDQISGLHGNSFHSEDEIEYENQKRLEEEED

SEQ ID NO: 6455 - protein, 40 aa, Artificial Sequence
  Description of Artificial Sequence: Synthetic polypeptide
VQIHPDSDQISGLHGNSFHSEDEIEYENQKRLEEEEDLNV

SEQ ID NO: 6456 - protein, 40 aa, Artificial Sequence
  Description of Artificial Sequence: Synthetic polypeptide
QIHPDSDQISGLHGNSFHSEDEIEYENQKRLEEEEDLNVL

SEQ ID NO: 6457 - protein, 40 aa, Artificial Sequence
  Description of Artificial Sequence: Synthetic polypeptide
HPDSDQISGLHGNSFHSEDEIEYENQKRLEEEEDLNVLTF

SEQ ID NO: 6458 - protein, 40 aa, Artificial Sequence
  Description of Artificial Sequence: Synthetic polypeptide
QISGLHGNSFHSEDEIEYENQKRLEEEEDLNVLTFEDLLC

SEQ ID NO: 6459 - protein, 40 aa, Artificial Sequence
  Description of Artificial Sequence: Synthetic polypeptide
IEYENQKRLEEEEDLNVLTFEDLLCFAYQVAKGMEFLEFK

SEQ ID NO: 6460 - protein, 40 aa, Artificial Sequence
  Description of Artificial Sequence: Synthetic polypeptide
YENQKRLEEEEDLNVLTFEDLLCFAYQVAKGMEFLEFKSC

SEQ ID NO: 6461 - protein, 40 aa, Artificial Sequence
  Description of Artificial Sequence: Synthetic polypeptide
MEFLEFKSCVHRDLAARNVLVTHGKVVKICDFGLARDIMS

SEQ ID NO: 6462 - protein, 40 aa, Artificial Sequence
  Description of Artificial Sequence: Synthetic polypeptide
FGLARDIMSDSNYVVRGNARLPVKWMAPESLFEGIYTIKS

SEQ ID NO: 6463 - protein, 40 aa, Artificial Sequence
  Description of Artificial Sequence: Synthetic polypeptide
NARLPVKWMAPESLFEGIYTIKSDVWSYGILLWEIFSLGV

SEQ ID NO: 6464 - protein, 40 aa, Artificial Sequence
  Description of Artificial Sequence: Synthetic polypeptide
ARLPVKWMAPESLFEGIYTIKSDVWSYGILLWEIFSLGVN

SEQ ID NO: 6465 - protein, 40 aa, Artificial Sequence
  Description of Artificial Sequence: Synthetic polypeptide
PVKWMAPESLFEGIYTIKSDVWSYGILLWEIFSLGVNPYP

SEQ ID NO: 6466 - protein, 40 aa, Artificial Sequence
  Description of Artificial Sequence: Synthetic polypeptide
MAPESLFEGIYTIKSDVWSYGILLWEIFSLGVNPYPGIPV

SEQ ID NO: 6467 - protein, 40 aa, Artificial Sequence
  Description of Artificial Sequence: Synthetic polypeptide
VWSYGILLWEIFSLGVNPYPGIPVDANFYKLIQNGFKMDQ

SEQ ID NO: 6468 - protein, 40 aa, Artificial Sequence
  Description of Artificial Sequence: Synthetic polypeptide
ILLWEIFSLGVNPYPGIPVDANFYKLIQNGFKMDQPFYAT

SEQ ID NO: 6469 - protein, 40 aa, Artificial Sequence
  Description of Artificial Sequence: Synthetic polypeptide
IPVDANFYKLIQNGFKMDQPFYATEEIYIIMQSCWAFDSR

SEQ ID NO: 6470 - protein, 40 aa, Artificial Sequence
  Description of Artificial Sequence: Synthetic polypeptide
VDANFYKLIQNGFKMDQPFYATEEIYIIMQSCWAFDSRKR

SEQ ID NO: 6471 - protein, 40 aa, Artificial Sequence
  Description of Artificial Sequence: Synthetic polypeptide
RPSFPNLTSFLGCQLADAEEAMYQNVDGRVSECPHTYQNR

SEQ ID NO: 6472 - protein, 40 aa, Artificial Sequence
  Description of Artificial Sequence: Synthetic polypeptide
MESMMACCLSDEVKESKRINAEIEKQLRRDKRDARRELKL

SEQ ID NO: 6473 - protein, 40 aa, Artificial Sequence
  Description of Artificial Sequence: Synthetic polypeptide
EVKESKRINAEIEKQLRRDKRDARRELKLLLLGTGESGKS

SEQ ID NO: 6474 - protein, 40 aa, Artificial Sequence
  Description of Artificial Sequence: Synthetic polypeptide
KESKRINAEIEKQLRRDKRDARRELKLLLLGTGESGKSTF

SEQ ID NO: 6475 - protein, 40 aa, Artificial Sequence
  Description of Artificial Sequence: Synthetic polypeptide
ESKRINAEIEKQLRRDKRDARRELKLLLLGTGESGKSTFI

SEQ ID NO: 6476 - protein, 40 aa, Artificial Sequence
  Description of Artificial Sequence: Synthetic polypeptide
RINAEIEKQLRRDKRDARRELKLLLLGTGESGKSTFIKQM

SEQ ID NO: 6477 - protein, 40 aa, Artificial Sequence
  Description of Artificial Sequence: Synthetic polypeptide
LKLLLLGTGESGKSTFIKQMRIIHGAGYSEEDKRGFTKLV

SEQ ID NO: 6478 - protein, 40 aa, Artificial Sequence
  Description of Artificial Sequence: Synthetic polypeptide
YKYEQNKANALLIREVDVEKVTTFEHQYVSAIKTLWEDPG

SEQ ID NO: 6479 - protein, 40 aa, Artificial Sequence
  Description of Artificial Sequence: Synthetic polypeptide
TQQDVLRVRVPTTGIIEYPFDLENIIFRMVDVGGQRSERR

SEQ ID NO: 6480 - protein, 40 aa, Artificial Sequence
  Description of Artificial Sequence: Synthetic polypeptide
PTTGIIEYPFDLENIIFRMVDVGGQRSERRKWIHCFENVT

SEQ ID NO: 6481 - protein, 40 aa, Artificial Sequence
  Description of Artificial Sequence: Synthetic polypeptide
TTGIIEYPFDLENIIFRMVDVGGQRSERRKWIHCFENVTS

SEQ ID NO: 6482 - protein, 40 aa, Artificial Sequence
  Description of Artificial Sequence: Synthetic polypeptide
SGKSTFIKQMRIIHGSGYSDEDKRGFTKLVYQNIFTAMQA

SEQ ID NO: 6483 - protein, 40 aa, Artificial Sequence
  Description of Artificial Sequence: Synthetic polypeptide
LKIPYKYEHNKAHAQLVREVDVEKVSAFENPYVDAIKSLW

SEQ ID NO: 6484 - protein, 40 aa, Artificial Sequence
  Description of Artificial Sequence: Synthetic polypeptide
PYKYEHNKAHAQLVREVDVEKVSAFENPYVDAIKSLWNDP

SEQ ID NO: 6485 - protein, 40 aa, Artificial Sequence
  Description of Artificial Sequence: Synthetic polypeptide
KYEHNKAHAQLVREVDVEKVSAFENPYVDAIKSLWNDPGI

SEQ ID NO: 6486 - protein, 40 aa, Artificial Sequence
  Description of Artificial Sequence: Synthetic polypeptide
AHAQLVREVDVEKVSAFENPYVDAIKSLWNDPGIQECYDR

SEQ ID NO: 6487 - protein, 40 aa, Artificial Sequence
  Description of Artificial Sequence: Synthetic polypeptide
AQLVREVDVEKVSAFENPYVDAIKSLWNDPGIQECYDRRR

SEQ ID NO: 6488 - protein, 40 aa, Artificial Sequence
  Description of Artificial Sequence: Synthetic polypeptide
QLVREVDVEKVSAFENPYVDAIKSLWNDPGIQECYDRRRE

SEQ ID NO: 6489 - protein, 40 aa, Artificial Sequence
  Description of Artificial Sequence: Synthetic polypeptide
REVDVEKVSAFENPYVDAIKSLWNDPGIQECYDRRREYQL

SEQ ID NO: 6490 - protein, 40 aa, Artificial Sequence
  Description of Artificial Sequence: Synthetic polypeptide
EVDVEKVSAFENPYVDAIKSLWNDPGIQECYDRRREYQLS

SEQ ID NO: 6491 - protein, 40 aa, Artificial Sequence
  Description of Artificial Sequence: Synthetic polypeptide
DVEKVSAFENPYVDAIKSLWNDPGIQECYDRRREYQLSDS

SEQ ID NO: 6492 - protein, 40 aa, Artificial Sequence
  Description of Artificial Sequence: Synthetic polypeptide
VEKVSAFENPYVDAIKSLWNDPGIQECYDRRREYQLSDST

SEQ ID NO: 6493 - protein, 40 aa, Artificial Sequence
  Description of Artificial Sequence: Synthetic polypeptide
SAFENPYVDAIKSLWNDPGIQECYDRRREYQLSDSTKYYL

SEQ ID NO: 6494 - protein, 40 aa, Artificial Sequence
  Description of Artificial Sequence: Synthetic polypeptide
ENPYVDAIKSLWNDPGIQECYDRRREYQLSDSTKYYLNDL

SEQ ID NO: 6495 - protein, 40 aa, Artificial Sequence
  Description of Artificial Sequence: Synthetic polypeptide
IFRMVDVGGQRSERRKWIHCFENVTSIMFLVALSEYDQVL

SEQ ID NO: 6496 - protein, 40 aa, Artificial Sequence
  Description of Artificial Sequence: Synthetic polypeptide
FRMVDVGGQRSERRKWIHCFENVTSIMFLVALSEYDQVLV

SEQ ID NO: 6497 - protein, 40 aa, Artificial Sequence
  Description of Artificial Sequence: Synthetic polypeptide
VGGQRSERRKWIHCFENVTSIMFLVALSEYDQVLVESDNE

SEQ ID NO: 6498 - protein, 40 aa, Artificial Sequence
  Description of Artificial Sequence: Synthetic polypeptide
ENVTSIMFLVALSEYDQVLVESDNENRMEESKALFRTIIT

SEQ ID NO: 6499 - protein, 40 aa, Artificial Sequence
  Description of Artificial Sequence: Synthetic polypeptide
NVTSIMFLVALSEYDQVLVESDNENRMEESKALFRTIITY

SEQ ID NO: 6500 - protein, 40 aa, Artificial Sequence
  Description of Artificial Sequence: Synthetic polypeptide
VTSIMFLVALSEYDQVLVESDNENRMEESKALFRTIITYP

SEQ ID NO: 6501 - protein, 40 aa, Artificial Sequence
  Description of Artificial Sequence: Synthetic polypeptide
ESDNENRMEESKALFRTIITYPWFQNSSVILFLNKKDLLE

SEQ ID NO: 6502 - protein, 40 aa, Artificial Sequence
  Description of Artificial Sequence: Synthetic polypeptide
SDNENRMEESKALFRTIITYPWFQNSSVILFLNKKDLLEE

SEQ ID NO: 6503 - protein, 40 aa, Artificial Sequence
  Description of Artificial Sequence: Synthetic polypeptide
DNENRMEESKALFRTIITYPWFQNSSVILFLNKKDLLEEK

SEQ ID NO: 6504 - protein, 40 aa, Artificial Sequence
  Description of Artificial Sequence: Synthetic polypeptide
NENRMEESKALFRTIITYPWFQNSSVILFLNKKDLLEEKI

SEQ ID NO: 6505 - protein, 40 aa, Artificial Sequence
  Description of Artificial Sequence: Synthetic polypeptide
MEESKALFRTIITYPWFQNSSVILFLNKKDLLEEKIMYSH

SEQ ID NO: 6506 - protein, 40 aa, Artificial Sequence
  Description of Artificial Sequence: Synthetic polypeptide
EESKALFRTIITYPWFQNSSVILFLNKKDLLEEKIMYSHL

SEQ ID NO: 6507 - protein, 40 aa, Artificial Sequence
  Description of Artificial Sequence: Synthetic polypeptide
SKALFRTIITYPWFQNSSVILFLNKKDLLEEKIMYSHLVD

SEQ ID NO: 6508 - protein, 40 aa, Artificial Sequence
  Description of Artificial Sequence: Synthetic polypeptide
KALFRTIITYPWFQNSSVILFLNKKDLLEEKIMYSHLVDY

SEQ ID NO: 6509 - protein, 40 aa, Artificial Sequence
  Description of Artificial Sequence: Synthetic polypeptide
VDLNPDSDKIIYSHFTCATDTENIRFVFAAVKDTILQLNL

SEQ ID NO: 6510 - protein, 40 aa, Artificial Sequence
  Description of Artificial Sequence: Synthetic polypeptide
DLNPDSDKIIYSHFTCATDTENIRFVFAAVKDTILQLNLK

SEQ ID NO: 6511 - protein, 40 aa, Artificial Sequence; identical to SEQ ID NO: 867
  Description of Artificial Sequence: Synthetic polypeptide

SEQ ID NO: 6512 - protein, 40 aa, Artificial Sequence
  Description of Artificial Sequence: Synthetic polypeptide
PGVVISDDEPGYDLDLFCIPNHYAEDLERVFIPHGLIMDR

SEQ ID NO: 6513 - protein, 40 aa, Artificial Sequence
  Description of Artificial Sequence: Synthetic polypeptide
DVMKEMGGHHIVALCVLKGGYKFFADLLDYIKALNRNSDR

SEQ ID NO: 6514 - protein, 40 aa, Artificial Sequence; identical to SEQ ID NO: 869
  Description of Artificial Sequence: Synthetic polypeptide

SEQ ID NO: 6515 - protein, 40 aa, Artificial Sequence; identical to SEQ ID NO: 2683
  Description of Artificial Sequence: Synthetic polypeptide

SEQ ID NO: 6516 - protein, 40 aa, Artificial Sequence
  Description of Artificial Sequence: Synthetic polypeptide
VALCVLKGGYKFFADLLDYIKALNRNSDRSIPMTVDFIRL

SEQ ID NO: 6517 - protein, 40 aa, Artificial Sequence
  Description of Artificial Sequence: Synthetic polypeptide
LKGGYKFFADLLDYIKALNRNSDRSIPMTVDFIRLKSYCN

SEQ ID NO: 6518 - protein, 40 aa, Artificial Sequence; identical to SEQ ID NO: 3142
  Description of Artificial Sequence: Synthetic polypeptide

SEQ ID NO: 6519 - protein, 40 aa, Artificial Sequence
  Description of Artificial Sequence: Synthetic polypeptide
IGGDDLSTLTGKNVLIVEDIIDTGKTMQTLLSLVRQYNPK

SEQ ID NO: 6520 - protein, 40 aa, Artificial Sequence
  Description of Artificial Sequence: Synthetic polypeptide
GDDLSTLTGKNVLIVEDIIDTGKTMQTLLSLVRQYNPKMV

SEQ ID NO: 6521 - protein, 40 aa, Artificial Sequence
  Description of Artificial Sequence: Synthetic polypeptide
KNVLIVEDIIDTGKTMQTLLSLVRQYNPKMVKVASLLVKR

SEQ ID NO: 6522 - protein, 40 aa, Artificial Sequence
  Description of Artificial Sequence: Synthetic polypeptide
VGYKPDFVGFEIPDKFVVGYALDYNEYFRDLNHVCVISET

SEQ ID NO: 6523 - protein, 40 aa, Artificial Sequence
  Description of Artificial Sequence: Synthetic polypeptide
DFVGFEIPDKFVVGYALDYNEYFRDLNHVCVISETGKAKY

SEQ ID NO: 6524 - protein, 40 aa, Artificial Sequence
  Description of Artificial Sequence: Synthetic polypeptide
VGFEIPDKFVVGYALDYNEYFRDLNHVCVISETGKAKYKA

SEQ ID NO: 6525 - protein, 39 aa, Artificial Sequence
  Description of Artificial Sequence: Synthetic polypeptide
GFEIPDKFVVGYALDYNEYFRDLNHVCVISETGKAKYKA

SEQ ID NO: 6526 - protein, 40 aa, Artificial Sequence
  Description of Artificial Sequence: Synthetic polypeptide
VVVGAGGVGKSALTIQLIQNHFVDEYDPTIEDSYRKQVVI

SEQ ID NO: 6527 - protein, 40 aa, Artificial Sequence
  Description of Artificial Sequence: Synthetic polypeptide
RTVESRQAQDLARSYGIPYIETSAKTRQGVEDAFYTLVRE

SEQ ID NO: 6528 - protein, 40 aa, Artificial Sequence
  Description of Artificial Sequence: Synthetic polypeptide
MSKKISGGSVVEMQGDEMTRIIWELIKEKLIFPYVELDLH

SEQ ID NO: 6529 - protein, 40 aa, Artificial Sequence
  Description of Artificial Sequence: Synthetic polypeptide
VEMQGDEMTRIIWELIKEKLIFPYVELDLHSYDLGIENRD

SEQ ID NO: 6530 - protein, 40 aa, Artificial Sequence
  Description of Artificial Sequence: Synthetic polypeptide
DLGIENRDATNDQVTKDAAEAIKKHNVGVKCATITPDEKR

SEQ ID NO: 6531 - protein, 40 aa, Artificial Sequence
  Description of Artificial Sequence: Synthetic polypeptide
NILGGTVFREAIICKNIPRLVSGWVKPIIIGRHAYGDQYR

SEQ ID NO: 6532 - protein, 40 aa, Artificial Sequence
  Description of Artificial Sequence: Synthetic polypeptide
GWVKPIIIGRHAYGDQYRATDFVVPGPGKVEITYTPSDGT

SEQ ID NO: 6533 - protein, 40 aa, Artificial Sequence
  Description of Artificial Sequence: Synthetic polypeptide
WVKPIIIGRHAYGDQYRATDFVVPGPGKVEITYTPSDGTQ

SEQ ID NO: 6534 - protein, 40 aa, Artificial Sequence
  Description of Artificial Sequence: Synthetic polypeptide
IIGRHAYGDQYRATDFVVPGPGKVEITYTPSDGTQKVTYL

SEQ ID NO: 6535 - protein, 40 aa, Artificial Sequence
  Description of Artificial Sequence: Synthetic polypeptide
IGRHAYGDQYRATDFVVPGPGKVEITYTPSDGTQKVTYLV

SEQ ID NO: 6536 - protein, 40 aa, Artificial Sequence
  Description of Artificial Sequence: Synthetic polypeptide
GRHAYGDQYRATDFVVPGPGKVEITYTPSDGTQKVTYLVH

SEQ ID NO: 6537 - protein, 40 aa, Artificial Sequence
  Description of Artificial Sequence: Synthetic polypeptide
RHAYGDQYRATDFVVPGPGKVEITYTPSDGTQKVTYLVHN

SEQ ID NO: 6538 - protein, 40 aa, Artificial Sequence
  Description of Artificial Sequence: Synthetic polypeptide
AYGDQYRATDFVVPGPGKVEITYTPSDGTQKVTYLVHNFE

SEQ ID NO: 6539 - protein, 40 aa, Artificial Sequence
  Description of Artificial Sequence: Synthetic polypeptide
GDQYRATDFVVPGPGKVEITYTPSDGTQKVTYLVHNFEEG

SEQ ID NO: 6540 - protein, 40 aa, Artificial Sequence
  Description of Artificial Sequence: Synthetic polypeptide
FVVPGPGKVEITYTPSDGTQKVTYLVHNFEEGGGVAMGMY

SEQ ID NO: 6541 - protein, 40 aa, Artificial Sequence
  Description of Artificial Sequence: Synthetic polypeptide
VPGPGKVEITYTPSDGTQKVTYLVHNFEEGGGVAMGMYNQ

SEQ ID NO: 6542 - protein, 40 aa, Artificial Sequence
  Description of Artificial Sequence: Synthetic polypeptide
GPGKVEITYTPSDGTQKVTYLVHNFEEGGGVAMGMYNQDK

SEQ ID NO: 6543 - protein, 40 aa, Artificial Sequence
  Description of Artificial Sequence: Synthetic polypeptide
GKVEITYTPSDGTQKVTYLVHNFEEGGGVAMGMYNQDKSI

SEQ ID NO: 6544 - protein, 40 aa, Artificial Sequence
  Description of Artificial Sequence: Synthetic polypeptide
KVEITYTPSDGTQKVTYLVHNFEEGGGVAMGMYNQDKSIE

SEQ ID NO: 6545 - protein, 40 aa, Artificial Sequence
  Description of Artificial Sequence: Synthetic polypeptide
PSDGTQKVTYLVHNFEEGGGVAMGMYNQDKSIEDFAHSSF

SEQ ID NO: 6546 - protein, 40 aa, Artificial Sequence
  Description of Artificial Sequence: Synthetic polypeptide
EDFAHSSFQMALSKGWPLYLSTKNTILKKYDGRFKDIFQE

SEQ ID NO: 6547 - protein, 40 aa, Artificial Sequence
  Description of Artificial Sequence: Synthetic polypeptide
FAHSSFQMALSKGWPLYLSTKNTILKKYDGRFKDIFQEIY

SEQ ID NO: 6548 - protein, 40 aa, Artificial Sequence
  Description of Artificial Sequence: Synthetic polypeptide
QMALSKGWPLYLSTKNTILKKYDGRFKDIFQEIYDKQYKS

SEQ ID NO: 6549 - protein, 40 aa, Artificial Sequence
  Description of Artificial Sequence: Synthetic polypeptide
SKGWPLYLSTKNTILKKYDGRFKDIFQEIYDKQYKSQFEA

SEQ ID NO: 6550 - protein, 40 aa, Artificial Sequence
  Description of Artificial Sequence: Synthetic polypeptide
NTILKKYDGRFKDIFQEIYDKQYKSQFEAQKIWYEHRLID

SEQ ID NO: 6551 - protein, 40 aa, Artificial Sequence
  Description of Artificial Sequence: Synthetic polypeptide
KQYKSQFEAQKIWYEHRLIDDMVAQAMKSEGGFIWACKNY

SEQ ID NO: 6552 - protein, 40 aa, Artificial Sequence
  Description of Artificial Sequence: Synthetic polypeptide
FIWACKNYDGDVQSDSVAQGYGSLGMMTSVLVCPDGKTVE

SEQ ID NO: 6553 - protein, 40 aa, Artificial Sequence
  Description of Artificial Sequence: Synthetic polypeptide
CKNYDGDVQSDSVAQGYGSLGMMTSVLVCPDGKTVEAEAA

SEQ ID NO: 6554 - protein, 40 aa, Artificial Sequence
  Description of Artificial Sequence: Synthetic polypeptide
ETSTNPIASIFAWTRGLAHRAKLDNNKELAFFANALEEVS

SEQ ID NO: 6555 - protein, 40 aa, Artificial Sequence
  Description of Artificial Sequence: Synthetic polypeptide
SIFAWTRGLAHRAKLDNNKELAFFANALEEVSIETIEAGF

SEQ ID NO: 6556 - protein, 40 aa, Artificial Sequence
  Description of Artificial Sequence: Synthetic polypeptide
KLDNNKELAFFANALEEVSIETIEAGFMTKDLAACIKGLP

SEQ ID NO: 6557 - protein, 40 aa, Artificial Sequence
  Description of Artificial Sequence: Synthetic polypeptide
FMTKDLAACIKGLPNVQRSDYLNTFEFMDKLGENLKIKLA

SEQ ID NO: 6558 - protein, 40 aa, Artificial Sequence
  Description of Artificial Sequence: Synthetic polypeptide
VRSLCRASGSRPAWAPAALTAPTSQEQPRRHYADKRIKVA

SEQ ID NO: 6559 - protein, 40 aa, Artificial Sequence
  Description of Artificial Sequence: Synthetic polypeptide
RSLCRASGSRPAWAPAALTAPTSQEQPRRHYADKRIKVAK

SEQ ID NO: 6560 - protein, 40 aa, Artificial Sequence
  Description of Artificial Sequence: Synthetic polypeptide
SLCRASGSRPAWAPAALTAPTSQEQPRRHYADKRIKVAKP

SEQ ID NO: 6561 - protein, 40 aa, Artificial Sequence
  Description of Artificial Sequence: Synthetic polypeptide
CRASGSRPAWAPAALTAPTSQEQPRRHYADKRIKVAKPVV

SEQ ID NO: 6562 - protein, 40 aa, Artificial Sequence
  Description of Artificial Sequence: Synthetic polypeptide
GSRPAWAPAALTAPTSQEQPRRHYADKRIKVAKPVVEMDG

SEQ ID NO: 6563 - protein, 40 aa, Artificial Sequence
  Description of Artificial Sequence: Synthetic polypeptide
EKLILPHVDIQLKYFDLGLPNRDQTDDQVTIDSALATQKY

SEQ ID NO: 6564 - protein, 40 aa, Artificial Sequence
  Description of Artificial Sequence: Synthetic polypeptide
VFTPKDGSGVKEWEVYNFPAGGVGMGMYNTDESISGFAHS

SEQ ID NO: 6565 - protein, 40 aa, Artificial Sequence
  Description of Artificial Sequence: Synthetic polypeptide
FQYAIQKKWPLYMSTKNTILKAYDGRFKDIFQEIFDKHYK

SEQ ID NO: 6566 - protein, 40 aa, Artificial Sequence
  Description of Artificial Sequence: Synthetic polypeptide
PLYMSTKNTILKAYDGRFKDIFQEIFDKHYKTDFDKNKIW

SEQ ID NO: 6567 - protein, 40 aa, Artificial Sequence
  Description of Artificial Sequence: Synthetic polypeptide
STKNTILKAYDGRFKDIFQEIFDKHYKTDFDKNKIWYEHR

SEQ ID NO: 6568 - protein, 40 aa, Artificial Sequence
  Description of Artificial Sequence: Synthetic polypeptide
TILKAYDGRFKDIFQEIFDKHYKTDFDKNKIWYEHRLIDD

SEQ ID NO: 6569 - protein, 40 aa, Artificial Sequence
  Description of Artificial Sequence: Synthetic polypeptide
ILKAYDGRFKDIFQEIFDKHYKTDFDKNKIWYEHRLIDDM

SEQ ID NO: 6570 - protein, 40 aa, Artificial Sequence
  Description of Artificial Sequence: Synthetic polypeptide
WYEHRLIDDMVAQVLKSSGGFVWACKNYDGDVQSDILAQG

SEQ ID NO: 6571 - protein, 40 aa, Artificial Sequence
  Description of Artificial Sequence: Synthetic polypeptide
GFGSLGLMTSVLVCPDGKTIEAEAAHGTVTRHYREHQKGR

SEQ ID NO: 6572 - protein, 40 aa, Artificial Sequence
  Description of Artificial Sequence: Synthetic polypeptide
NLSHCQLVTLISRDDLNVRCESEVFHACINWVKYDCEQRR

SEQ ID NO: 6573 - protein, 40 aa, Artificial Sequence
  Description of Artificial Sequence: Synthetic polypeptide
TLISRDDLNVRCESEVFHACINWVKYDCEQRRFYVQALLR

SEQ ID NO: 6574 - protein, 40 aa, Artificial Sequence
  Description of Artificial Sequence: Synthetic polypeptide
YVQALLRAVRCHSLTPNFLQMQLQKCEILQSDSRCKDYLV

SEQ ID NO: 6575 - protein, 40 aa, Artificial Sequence
  Description of Artificial Sequence: Synthetic polypeptide
KIFEELTLHKPTQVMPCRAPKVGRLIYTAGGYFRQSLSYL

SEQ ID NO: 6576 - protein, 40 aa, Artificial Sequence
  Description of Artificial Sequence: Synthetic polypeptide
ELTLHKPTQVMPCRAPKVGRLIYTAGGYFRQSLSYLEAYN

SEQ ID NO: 6577 - protein, 40 aa, Artificial Sequence
  Description of Artificial Sequence: Synthetic polypeptide
QVMPCRAPKVGRLIYTAGGYFRQSLSYLEAYNPSDGTWLR

SEQ ID NO: 6578 - protein, 40 aa, Artificial Sequence
  Description of Artificial Sequence: Synthetic polypeptide
PKVGRLIYTAGGYFRQSLSYLEAYNPSDGTWLRLADLQVP

SEQ ID NO: 6579 - protein, 40 aa, Artificial Sequence
  Description of Artificial Sequence: Synthetic polypeptide
PSDGTWLRLADLQVPRSGLAGCVVGGLLYAVGGRNNSPDG

SEQ ID NO: 6580 - protein, 40 aa, Artificial Sequence
  Description of Artificial Sequence: Synthetic polypeptide
TWLRLADLQVPRSGLAGCVVGGLLYAVGGRNNSPDGNTDS

SEQ ID NO: 6581 - protein, 40 aa, Artificial Sequence
  Description of Artificial Sequence: Synthetic polypeptide
GVGVAVLNRLLYAVGGFDGTNRLNSAECYYPERNEWRMIT

SEQ ID NO: 6582 - protein, 40 aa, Artificial Sequence
  Description of Artificial Sequence: Synthetic polypeptide
RSGAGVCVLHNCIYAAGGYDGQDQLNSVERYDVETETWTF

SEQ ID NO: 6583 - protein, 40 aa, Artificial Sequence
  Description of Artificial Sequence: Synthetic polypeptide
CTDPGFVKWTFEILDETNENKQNEWITEKAEATNTGKYTC

SEQ ID NO: 6584 - protein, 40 aa, Artificial Sequence
  Description of Artificial Sequence: Synthetic polypeptide
NEWITEKAEATNTGKYTCTNKHGLSNSIYVFVRDPAKLFL

SEQ ID NO: 6585 - protein, 40 aa, Artificial Sequence
  Description of Artificial Sequence: Synthetic polypeptide
PKAGIMIKSVKRAYHRLCLHCSVDQEGKSVLSEKFILKVR

SEQ ID NO: 6586 - protein, 40 aa, Artificial Sequence
  Description of Artificial Sequence: Synthetic polypeptide
ILKVRPAFKAVPVVSVSKASYLLREGEEFTVTCTIKDVSS

SEQ ID NO: 6587 - protein, 40 aa, Artificial Sequence
  Description of Artificial Sequence: Synthetic polypeptide
LLREGEEFTVTCTIKDVSSSVYSTWKRENSQTKLQEKYNS

SEQ ID NO: 6588 - protein, 40 aa, Artificial Sequence
  Description of Artificial Sequence: Synthetic polypeptide
LREGEEFTVTCTIKDVSSSVYSTWKRENSQTKLQEKYNSW

SEQ ID NO: 6589 - protein, 40 aa, Artificial Sequence
  Description of Artificial Sequence: Synthetic polypeptide
EGEEFTVTCTIKDVSSSVYSTWKRENSQTKLQEKYNSWHH

SEQ ID NO: 6590 - protein, 40 aa, Artificial Sequence
  Description of Artificial Sequence: Synthetic polypeptide
EFTVTCTIKDVSSSVYSTWKRENSQTKLQEKYNSWHHGDF

SEQ ID NO: 6591 - protein, 40 aa, Artificial Sequence
  Description of Artificial Sequence: Synthetic polypeptide
FTVTCTIKDVSSSVYSTWKRENSQTKLQEKYNSWHHGDFN

SEQ ID NO: 6592 - protein, 40 aa, Artificial Sequence
  Description of Artificial Sequence: Synthetic polypeptide
KRENSQTKLQEKYNSWHHGDFNYERQATLTISSARVNDSG

SEQ ID NO: 6593 - protein, 40 aa, Artificial Sequence
  Description of Artificial Sequence: Synthetic polypeptide
SQTKLQEKYNSWHHGDFNYERQATLTISSARVNDSGVFMC

SEQ ID NO: 6594 - protein, 40 aa, Artificial Sequence
  Description of Artificial Sequence: Synthetic polypeptide
RQATLTISSARVNDSGVFMCYANNTFGSANVTTTLEVVDK

SEQ ID NO: 6595 - protein, 40 aa, Artificial Sequence
  Description of Artificial Sequence: Synthetic polypeptide
MTISSARVNDSGVFMCYANNTFGSANVTTTLEVVDKGFIN

SEQ ID NO: 6596 - protein, 40 aa, Artificial Sequence
  Description of Artificial Sequence: Synthetic polypeptide
ISSARVNDSGVFMCYANNTFGSANVTTTLEVVDKGFINIF

SEQ ID NO: 6597 - protein, 40 aa, Artificial Sequence
  Description of Artificial Sequence: Synthetic polypeptide
ARVNDSGVFMCYANNTFGSANVTTTLEVVDKGFINIFPMI

SEQ ID NO: 6598 - protein, 40 aa, Artificial Sequence
  Description of Artificial Sequence: Synthetic polypeptide
ANNTFGSANVTTTLEVVDKGFINIFPMINTTVFVNDGENV

SEQ ID NO: 6599 - protein, 40 aa, Artificial Sequence
  Description of Artificial Sequence: Synthetic polypeptide
MEVVDKGFINIFPMINTTVFVNDGENVDLIVEYEAFPKPE

SEQ ID NO: 6600 - protein, 40 aa, Artificial Sequence
  Description of Artificial Sequence: Synthetic polypeptide
FINIFPMINTTVFVNDGENVDLIVEYEAFPKPEHQQWIYM

SEQ ID NO: 6601 - protein, 40 aa, Artificial Sequence
  Description of Artificial Sequence: Synthetic polypeptide
MIVEYEAFPKPEHQQWIYMNRTFTDKWEDYPKSENESNIR

SEQ ID NO: 6602 - protein, 40 aa, Artificial Sequence
  Description of Artificial Sequence: Synthetic polypeptide
KPEHQQWIYMNRTFTDKWEDYPKSENESNIRYVSELHLTR

SEQ ID NO: 6603 - protein, 40 aa, Artificial Sequence
  Description of Artificial Sequence: Synthetic polypeptide
WIYMNRTFTDKWEDYPKSENESNIRYVSELHLTRLKGTEG

SEQ ID NO: 6604 - protein, 40 aa, Artificial Sequence
  Description of Artificial Sequence: Synthetic polypeptide
RTFTDKWEDYPKSENESNIRYVSELHLTRLKGTEGGTYTF

SEQ ID NO: 6605 - protein, 40 aa, Artificial Sequence
  Description of Artificial Sequence: Synthetic polypeptide
WEDYPKSENESNIRYVSELHLTRLKGTEGGTYTFLVSNSD

SEQ ID NO: 6606 - protein, 40 aa, Artificial Sequence
  Description of Artificial Sequence: Synthetic polypeptide
EDYPKSENESNIRYVSELHLTRLKGTEGGTYTFLVSNSDV

SEQ ID NO: 6607 - protein, 40 aa, Artificial Sequence
  Description of Artificial Sequence: Synthetic polypeptide
SENESNIRYVSELHLTRLKGTEGGTYTFLVSNSDVNAAIA

SEQ ID NO: 6608 - protein, 40 aa, Artificial Sequence
  Description of Artificial Sequence: Synthetic polypeptide
ENESNIRYVSELHLTRLKGTEGGTYTFLVSNSDVNAAIAF

SEQ ID NO: 6609 - protein, 40 aa, Artificial Sequence
  Description of Artificial Sequence: Synthetic polypeptide
NESNIRYVSELHLTRLKGTEGGTYTFLVSNSDVNAAIAFN

SEQ ID NO: 6610 - protein, 40 aa, Artificial Sequence
  Description of Artificial Sequence: Synthetic polypeptide
ESNIRYVSELHLTRLKGTEGGTYTFLVSNSDVNAAIAFNV

SEQ ID NO: 6611 - protein, 40 aa, Artificial Sequence
  Description of Artificial Sequence: Synthetic polypeptide
SNIRYVSELHLTRLKGTEGGTYTFLVSNSDVNAAIAFNVY

SEQ ID NO: 6612 - protein, 40 aa, Artificial Sequence
  Description of Artificial Sequence: Synthetic polypeptide
NIRYVSELHLTRLKGTEGGTYTFLVSNSDVNAAIAFNVYV

SEQ ID NO: 6613 - protein, 40 aa, Artificial Sequence
  Description of Artificial Sequence: Synthetic polypeptide
YVSELHLTRLKGTEGGTYTFLVSNSDVNAAIAFNVYVNTK

SEQ ID NO: 6614 - protein, 40 aa, Artificial Sequence
  Description of Artificial Sequence: Synthetic polypeptide
VSELHLTRLKGTEGGTYTFLVSNSDVNAAIAFNVYVNTKP

SEQ ID NO: 6615 - protein, 40 aa, Artificial Sequence
  Description of Artificial Sequence: Synthetic polypeptide
LHLTRLKGTEGGTYTFLVSNSDVNAAIAFNVYVNTKPEIL

SEQ ID NO: 6616 - protein, 40 aa, Artificial Sequence
  Description of Artificial Sequence: Synthetic polypeptide
LTRLKGTEGGTYTFLVSNSDVNAAIAFNVYVNTKPEILTY

SEQ ID NO: 6617 - protein, 40 aa, Artificial Sequence
  Description of Artificial Sequence: Synthetic polypeptide
LKGTEGGTYTFLVSNSDVNAAIAFNVYVNTKPEILTYDRL

SEQ ID NO: 6618 - protein, 40 aa, Artificial Sequence
  Description of Artificial Sequence: Synthetic polypeptide
LQCVAAGFPEPTIDWYFCPGTEQRCSASVLPVDVQTLNSS

SEQ ID NO: 6619 - protein, 40 aa, Artificial Sequence
  Description of Artificial Sequence: Synthetic polypeptide
VAAGFPEPTIDWYFCPGTEQRCSASVLPVDVQTLNSSGPP

SEQ ID NO: 6620 - protein, 40 aa, Artificial Sequence
  Description of Artificial Sequence: Synthetic polypeptide
SVLPVDVQTLNSSGPPFGKLVVQSSIDSSAFKHNGTVECK

SEQ ID NO: 6621 - protein, 40 aa, Artificial Sequence
  Description of Artificial Sequence: Synthetic polypeptide
PPFGKLVVQSSIDSSAFKHNGTVECKAYNDVGKTSAYFNF

SEQ ID NO: 6622 - protein, 40 aa, Artificial Sequence
  Description of Artificial Sequence: Synthetic polypeptide
PFGKLVVQSSIDSSAFKHNGTVECKAYNDVGKTSAYFNFA

SEQ ID NO: 6623 - protein, 40 aa, Artificial Sequence
  Description of Artificial Sequence: Synthetic polypeptide
GKLVVQSSIDSSAFKHNGTVECKAYNDVGKTSAYFNFAFK

SEQ ID NO: 6624 - protein, 40 aa, Artificial Sequence
  Description of Artificial Sequence: Synthetic polypeptide
LVVQSSIDSSAFKHNGTVECKAYNDVGKTSAYFNFAFKGN

SEQ ID NO: 6625 - protein, 40 aa, Artificial Sequence
  Description of Artificial Sequence: Synthetic polypeptide
VVQSSIDSSAFKHNGTVECKAYNDVGKTSAYFNFAFKGNN

SEQ ID NO: 6626 - protein, 40 aa, Artificial Sequence
  Description of Artificial Sequence: Synthetic polypeptide
SSAFKHNGTVECKAYNDVGKTSAYFNFAFKGNNKEQIHPH

SEQ ID NO: 6627 - protein, 40 aa, Artificial Sequence
  Description of Artificial Sequence: Synthetic polypeptide
AFKHNGTVECKAYNDVGKTSAYFNFAFKGNNKEQIHPHTL

SEQ ID NO: 6628 - protein, 40 aa, Artificial Sequence
  Description of Artificial Sequence: Synthetic polypeptide
FKHNGTVECKAYNDVGKTSAYFNFAFKGNNKEQIHPHTLF

SEQ ID NO: 6629 - protein, 40 aa, Artificial Sequence
  Description of Artificial Sequence: Synthetic polypeptide
NGTVECKAYNDVGKTSAYFNFAFKGNNKEQIHPHTLFTPL

SEQ ID NO: 6630 - protein, 40 aa, Artificial Sequence
  Description of Artificial Sequence: Synthetic polypeptide
TVECKAYNDVGKTSAYFNFAFKGNNKEQIHPHTLFTPLLI

SEQ ID NO: 6631 - protein, 40 aa, Artificial Sequence
  Description of Artificial Sequence: Synthetic polypeptide
ECKAYNDVGKTSAYFNFAFKGNNKEQIHPHTLFTPLLIGF

SEQ ID NO: 6632 - protein, 40 aa, Artificial Sequence
  Description of Artificial Sequence: Synthetic polypeptide
KAYNDVGKTSAYFNFAFKGNNKEQIHPHTLFTPLLIGFVI

SEQ ID NO: 6633 - protein, 40 aa, Artificial Sequence
  Description of Artificial Sequence: Synthetic polypeptide
AYNDVGKTSAYFNFAFKGNNKEQIHPHTLFTPLLIGFVIV

SEQ ID NO: 6634 - protein, 40 aa, Artificial Sequence
  Description of Artificial Sequence: Synthetic polypeptide
YNDVGKTSAYFNFAFKGNNKEQIHPHTLFTPLLIGFVIVA

SEQ ID NO: 6635 - protein, 40 aa, Artificial Sequence
  Description of Artificial Sequence: Synthetic polypeptide
SAYFNFAFKGNNKEQIHPHTLFTPLLIGFVIVAGMMCIIV

SEQ ID NO: 6636 - protein, 40 aa, Artificial Sequence
  Description of Artificial Sequence: Synthetic polypeptide
FNFAFKGNNKEQIHPHTLFTPLLIGFVIVAGMMCIIVMIL

SEQ ID NO: 6637 - protein, 40 aa, Artificial Sequence
  Description of Artificial Sequence: Synthetic polypeptide
FAFKGNNKEQIHPHTLFTPLLIGFVIVAGMMCIIVMILTY

SEQ ID NO: 6638 - protein, 40 aa, Artificial Sequence
  Description of Artificial Sequence: Synthetic polypeptide
AFKGNNKEQIHPHTLFTPLLIGFVIVAGMMCIIVMILTYK

SEQ ID NO: 6639 - protein, 40 aa, Artificial Sequence
  Description of Artificial Sequence: Synthetic polypeptide
FKGNNKEQIHPHTLFTPLLIGFVIVAGMMCIIVMILTYKY

SEQ ID NO: 6640 - protein, 40 aa, Artificial Sequence
  Description of Artificial Sequence: Synthetic polypeptide
EQIHPHTLFTPLLIGFVIVAGMMCIIVMILTYKYLQKPMY

SEQ ID NO: 6641 - protein, 40 aa, Artificial Sequence
  Description of Artificial Sequence: Synthetic polypeptide
HTLFTPLLIGFVIVAGMMCIIVMILTYKYLQKPMYEVQWK

SEQ ID NO: 6642 - protein, 40 aa, Artificial Sequence
  Description of Artificial Sequence: Synthetic polypeptide
TLFTPLLIGFVIVAGMMCIIVMILTYKYLQKPMYEVQWKV

SEQ ID NO: 6643 - protein, 40 aa, Artificial Sequence
  Description of Artificial Sequence: Synthetic polypeptide
FTPLLIGFVIVAGMMCIIVMILTYKYLQKPMYEVQWKVVE

SEQ ID NO: 6644 - protein, 40 aa, Artificial Sequence
  Description of Artificial Sequence: Synthetic polypeptide
TPLLIGFVIVAGMMCIIVMILTYKYLQKPMYEVQWKVVEE

SEQ ID NO: 6645 - protein, 40 aa, Artificial Sequence
  Description of Artificial Sequence: Synthetic polypeptide
MIGFVIVAGMMCIIVMILTYKYLQKPMYEVQWKVVEEING

SEQ ID NO: 6646 - protein, 40 aa, Artificial Sequence
  Description of Artificial Sequence: Synthetic polypeptide
GFVIVAGMMCIIVMILTYKYLQKPMYEVQWKVVEEINGNN

SEQ ID NO: 6647 - protein, 40 aa, Artificial Sequence
  Description of Artificial Sequence: Synthetic polypeptide
IVAGMMCIIVMILTYKYLQKPMYEVQWKVVEEINGNNYVY

SEQ ID NO: 6648 - protein, 40 aa, Artificial Sequence
  Description of Artificial Sequence: Synthetic polypeptide
VAGMMCIIVMILTYKYLQKPMYEVQWKVVEEINGNNYVYI

SEQ ID NO: 6649 - protein, 40 aa, Artificial Sequence
  Description of Artificial Sequence: Synthetic polypeptide
IIVMILTYKYLQKPMYEVQWKVVEEINGNNYVYIDPTQLP

SEQ ID NO: 6650 - protein, 40 aa, Artificial Sequence
  Description of Artificial Sequence: Synthetic polypeptide
IVMILTYKYLQKPMYEVQWKVVEEINGNNYVYIDPTQLPY

SEQ ID NO: 6651 - protein, 40 aa, Artificial Sequence
  Description of Artificial Sequence: Synthetic polypeptide
MILTYKYLQKPMYEVQWKVVEEINGNNYVYIDPTQLPYDH

SEQ ID NO: 6652 - protein, 40 aa, Artificial Sequence
  Description of Artificial Sequence: Synthetic polypeptide
YKYLQKPMYEVQWKVVEEINGNNYVYIDPTQLPYDHKWEF

SEQ ID NO: 6653 - protein, 40 aa, Artificial Sequence
  Description of Artificial Sequence: Synthetic polypeptide
KYLQKPMYEVQWKVVEEINGNNYVYIDPTQLPYDHKWEFP

SEQ ID NO: 6654 - protein, 40 aa, Artificial Sequence
  Description of Artificial Sequence: Synthetic polypeptide
EEINGNNYVYIDPTQLPYDHKWEFPRNRLSFGKTLGAGAF

SEQ ID NO: 6655 - protein, 40 aa, Artificial Sequence
  Description of Artificial Sequence: Synthetic polypeptide
INGNNYVYIDPTQLPYDHKWEFPRNRLSFGKTLGAGAFGK

SEQ ID NO: 6656 - protein, 40 aa, Artificial Sequence
  Description of Artificial Sequence: Synthetic polypeptide
NGNNYVYIDPTQLPYDHKWEFPRNRLSFGKTLGAGAFGKV

SEQ ID NO: 6657 - protein, 40 aa, Artificial Sequence
  Description of Artificial Sequence: Synthetic polypeptide
LPYDHKWEFPRNRLSFGKTLGAGAFGKVVEATAYGLIKSD

SEQ ID NO: 6658 - protein, 40 aa, Artificial Sequence
  Description of Artificial Sequence: Synthetic polypeptide
PYDHKWEFPRNRLSFGKTLGAGAFGKVVEATAYGLIKSDA

SEQ ID NO: 6659 - protein, 40 aa, Artificial Sequence
  Description of Artificial Sequence: Synthetic polypeptide
EFPRNRLSFGKTLGAGAFGKVVEATAYGLIKSDAAMTVAV

SEQ ID NO: 6660 - protein, 40 aa, Artificial Sequence
  Description of Artificial Sequence: Synthetic polypeptide
FGKVVEATAYGLIKSDAAMTVAVKMLKPSAHLTEREALMS

SEQ ID NO: 6661 - protein, 40 aa, Artificial Sequence
  Description of Artificial Sequence: Synthetic polypeptide
KPSAHLTEREALMSELKVLSYLGNHMNIVNLLGACTIGGP

SEQ ID NO: 6662 - protein, 40 aa, Artificial Sequence
  Description of Artificial Sequence: Synthetic polypeptide
LMSELKVLSYLGNHMNIVNLLGACTIGGPTLVITEYCCYG

SEQ ID NO: 6663 - protein, 40 aa, Artificial Sequence
  Description of Artificial Sequence: Synthetic polypeptide
ELKVLSYLGNHMNIVNLLGACTIGGPTLVITEYCCYGDLL

SEQ ID NO: 6664 - protein, 40 aa, Artificial Sequence
  Description of Artificial Sequence: Synthetic polypeptide
YLGNHMNIVNLLGACTIGGPTLVITEYCCYGDLLNFLRRK

SEQ ID NO: 6665 - protein, 40 aa, Artificial Sequence
  Description of Artificial Sequence: Synthetic polypeptide
NLLGACTIGGPTLVITEYCCYGDLLNFLRRKRDSFICSKQ

SEQ ID NO: 6666 - protein, 40 aa, Artificial Sequence
  Description of Artificial Sequence: Synthetic polypeptide
ACTIGGPTLVITEYCCYGDLLNFLRRKRDSFICSKQEDHA

SEQ ID NO: 6667 - protein, 40 aa, Artificial Sequence
  Description of Artificial Sequence: Synthetic polypeptide
TIGGPTLVITEYCCYGDLLNFLRRKRDSFICSKQEDHAEA

SEQ ID NO: 6668 - protein, 40 aa, Artificial Sequence
  Description of Artificial Sequence: Synthetic polypeptide
IGGPTLVITEYCCYGDLLNFLRRKRDSFICSKQEDHAEAA

SEQ ID NO: 6669 - protein, 40 aa, Artificial Sequence
  Description of Artificial Sequence: Synthetic polypeptide
GPTLVITEYCCYGDLLNFLRRKRDSFICSKQEDHAEAALY

SEQ ID NO: 6670 - protein, 40 aa, Artificial Sequence
  Description of Artificial Sequence: Synthetic polypeptide
PTLVITEYCCYGDLLNFLRRKRDSFICSKQEDHAEAALYK

SEQ ID NO: 6671 - protein, 40 aa, Artificial Sequence
  Description of Artificial Sequence: Synthetic polypeptide
TLVITEYCCYGDLLNFLRRKRDSFICSKQEDHAEAALYKN

SEQ ID NO: 6672 - protein, 40 aa, Artificial Sequence
  Description of Artificial Sequence: Synthetic polypeptide
MVITEYCCYGDLLNFLRRKRDSFICSKQEDHAEAALYKNL

SEQ ID NO: 6673 - protein, 40 aa, Artificial Sequence
  Description of Artificial Sequence: Synthetic polypeptide
VITEYCCYGDLLNFLRRKRDSFICSKQEDHAEAALYKNLL

SEQ ID NO: 6674 - protein, 40 aa, Artificial Sequence
  Description of Artificial Sequence: Synthetic polypeptide
TEYCCYGDLLNFLRRKRDSFICSKQEDHAEAALYKNLLHS

SEQ ID NO: 6675 - protein, 40 aa, Artificial Sequence
  Description of Artificial Sequence: Synthetic polypeptide
EYCCYGDLLNFLRRKRDSFICSKQEDHAEAALYKNLLHSK

SEQ ID NO: 6676 - protein, 40 aa, Artificial Sequence
  Description of Artificial Sequence: Synthetic polypeptide
YCCYGDLLNFLRRKRDSFICSKQEDHAEAALYKNLLHSKE

SEQ ID NO: 6677 - protein, 40 aa, Artificial Sequence
  Description of Artificial Sequence: Synthetic polypeptide
CCYGDLLNFLRRKRDSFICSKQEDHAEAALYKNLLHSKES

SEQ ID NO: 6678 - protein, 40 aa, Artificial Sequence
  Description of Artificial Sequence: Synthetic polypeptide
YGDLLNFLRRKRDSFICSKQEDHAEAALYKNLLHSKESSC

SEQ ID NO: 6679 - protein, 40 aa, Artificial Sequence
  Description of Artificial Sequence: Synthetic polypeptide
DLLNFLRRKRDSFICSKQEDHAEAALYKNLLHSKESSCSD

SEQ ID NO: 6680 - protein, 40 aa, Artificial Sequence
  Description of Artificial Sequence: Synthetic polypeptide
LLNFLRRKRDSFICSKQEDHAEAALYKNLLHSKESSCSDS

SEQ ID NO: 6681 - protein, 40 aa, Artificial Sequence
  Description of Artificial Sequence: Synthetic polypeptide
DHAEAALYKNLLHSKESSCSDSTNEYMDMKPGVSYVVPTK

SEQ ID NO: 6682 - protein, 40 aa, Artificial Sequence
  Description of Artificial Sequence: Synthetic polypeptide
EAALYKNLLHSKESSCSDSTNEYMDMKPGVSYVVPTKADK

SEQ ID NO: 6683 - protein, 40 aa, Artificial Sequence
  Description of Artificial Sequence: Synthetic polypeptide
NLLHSKESSCSDSTNEYMDMKPGVSYVVPTKADKRRSVRI

SEQ ID NO: 6684 - protein, 40 aa, Artificial Sequence
  Description of Artificial Sequence: Synthetic polypeptide
STNEYMDMKPGVSYVVPTKADKRRSVRIGSYIERDVTPAI

SEQ ID NO: 6685 - protein, 40 aa, Artificial Sequence
  Description of Artificial Sequence: Synthetic polypeptide
NEYMDMKPGVSYVVPTKADKRRSVRIGSYIERDVTPAIME

SEQ ID NO: 6686 - protein, 40 aa, Artificial Sequence
  Description of Artificial Sequence: Synthetic polypeptide
EYMDMKPGVSYVVPTKADKRRSVRIGSYIERDVTPAIMED

SEQ ID NO: 6687 - protein, 40 aa, Artificial Sequence
  Description of Artificial Sequence: Synthetic polypeptide
MDMKPGVSYVVPTKADKRRSVRIGSYIERDVTPAIMEDDE

SEQ ID NO: 6688 - protein, 40 aa, Artificial Sequence
  Description of Artificial Sequence: Synthetic polypeptide
EDDELALDLEDLLSFSYQVAKGMAFLASKNCIHRDLAARN

SEQ ID NO: 6689 - protein, 40 aa, Artificial Sequence
  Description of Artificial Sequence: Synthetic polypeptide
ELALDLEDLLSFSYQVAKGMAFLASKNCIHRDLAARNILL

SEQ ID NO: 6690 - protein, 40 aa, Artificial Sequence
  Description of Artificial Sequence: Synthetic polypeptide
MSFSYQVAKGMAFLASKNCIHRDLAARNILLTHGRITKIC

SEQ ID NO: 6691 - protein, 40 aa, Artificial Sequence
  Description of Artificial Sequence: Synthetic polypeptide
FSYQVAKGMAFLASKNCIHRDLAARNILLTHGRITKICDF

SEQ ID NO: 6692 - protein, 40 aa, Artificial Sequence
  Description of Artificial Sequence: Synthetic polypeptide
RNILLTHGRITKICDFGLARDIKNDSNYVVKGNARLPVKW

SEQ ID NO: 6693 - protein, 40 aa, Artificial Sequence
  Description of Artificial Sequence: Synthetic polypeptide
THGRITKICDFGLARDIKNDSNYVVKGNARLPVKWMAPES

SEQ ID NO: 6694 - protein, 40 aa, Artificial Sequence
  Description of Artificial Sequence: Synthetic polypeptide
KNDSNYVVKGNARLPVKWMAPESIFNCVYTFESDVWSYGI

SEQ ID NO: 6695 - protein, 40 aa, Artificial Sequence
  Description of Artificial Sequence: Synthetic polypeptide
KGNARLPVKWMAPESIFNCVYTFESDVWSYGIFLWELFSL

SEQ ID NO: 6696 - protein, 40 aa, Artificial Sequence
  Description of Artificial Sequence: Synthetic polypeptide
ARLPVKWMAPESIFNCVYTFESDVWSYGIFLWELFSLGSS

SEQ ID NO: 6697 - protein, 40 aa, Artificial Sequence
  Description of Artificial Sequence: Synthetic polypeptide
LPVKWMAPESIFNCVYTFESDVWSYGIFLWELFSLGSSPY

SEQ ID NO: 6698 - protein, 40 aa, Artificial Sequence
  Description of Artificial Sequence: Synthetic polypeptide
KWMAPESIFNCVYTFESDVWSYGIFLWELFSLGSSPYPGM

SEQ ID NO: 6699 - protein, 40 aa, Artificial Sequence
  Description of Artificial Sequence: Synthetic polypeptide
WMAPESIFNCVYTFESDVWSYGIFLWELFSLGSSPYPGMP

SEQ ID NO: 6700 - protein, 40 aa, Artificial Sequence
  Description of Artificial Sequence: Synthetic polypeptide
MAPESIFNCVYTFESDVWSYGIFLWELFSLGSSPYPGMPV

SEQ ID NO: 6701 - protein, 40 aa, Artificial Sequence
  Description of Artificial Sequence: Synthetic polypeptide
ESIFNCVYTFESDVWSYGIFLWELFSLGSSPYPGMPVDSK

SEQ ID NO: 6702 - protein, 40 aa, Artificial Sequence
  Description of Artificial Sequence: Synthetic polypeptide
SIFNCVYTFESDVWSYGIFLWELFSLGSSPYPGMPVDSKF

SEQ ID NO: 6703 - protein, 40 aa, Artificial Sequence
  Description of Artificial Sequence: Synthetic polypeptide
IFNCVYTFESDVWSYGIFLWELFSLGSSPYPGMPVDSKFY

SEQ ID NO: 6704 - protein, 40 aa, Artificial Sequence
  Description of Artificial Sequence: Synthetic polypeptide
FESDVWSYGIFLWELFSLGSSPYPGMPVDSKFYKMIKEGF

SEQ ID NO: 6705 - protein, 40 aa, Artificial Sequence
  Description of Artificial Sequence: Synthetic polypeptide
ESDVWSYGIFLWELFSLGSSPYPGMPVDSKFYKMIKEGFR

SEQ ID NO: 6706 - protein, 40 aa, Artificial Sequence
  Description of Artificial Sequence: Synthetic polypeptide
SDVWSYGIFLWELFSLGSSPYPGMPVDSKFYKMIKEGFRM

SEQ ID NO: 6707 - protein, 40 aa, Artificial Sequence
  Description of Artificial Sequence: Synthetic polypeptide
PYPGMPVDSKFYKMIKEGFRMLSPEHAPAEMYDIMKTCWD

SEQ ID NO: 6708 - protein, 40 aa, Artificial Sequence
  Description of Artificial Sequence: Synthetic polypeptide
TEYKLVVVGAGGVGKSALTIQLIQNHFVDEYDPTIEDSYR

SEQ ID NO: 6709 - protein, 40 aa, Artificial Sequence
  Description of Artificial Sequence: Synthetic polypeptide
KSALTIQLIQNHFVDEYDPTIEDSYRKQVVIDGETCLLDI

SEQ ID NO: 6710 - protein, 40 aa, Artificial Sequence
  Description of Artificial Sequence: Synthetic polypeptide
PTIEDSYRKQVVIDGETCLLDILDTAGQEEYSAMRDQYMR

SEQ ID NO: 6711 - protein, 40 aa, Artificial Sequence
  Description of Artificial Sequence: Synthetic polypeptide
VIDGETCLLDILDTAGQEEYSAMRDQYMRTGEGFLCVFAI

SEQ ID NO: 6712 - protein, 40 aa, Artificial Sequence
  Description of Artificial Sequence: Synthetic polypeptide
ETCLLDILDTAGQEEYSAMRDQYMRTGEGFLCVFAINNTK

SEQ ID NO: 6713 - protein, 40 aa, Artificial Sequence
  Description of Artificial Sequence: Synthetic polypeptide
ILDTAGQEEYSAMRDQYMRTGEGFLCVFAINNTKSFEDIH

SEQ ID NO: 6714 - protein, 40 aa, Artificial Sequence
  Description of Artificial Sequence: Synthetic polypeptide
DTAGQEEYSAMRDQYMRTGEGFLCVFAINNTKSFEDIHHY

SEQ ID NO: 6715 - protein, 40 aa, Artificial Sequence
  Description of Artificial Sequence: Synthetic polypeptide
QEEYSAMRDQYMRTGEGFLCVFAINNTKSFEDIHHYREQI

SEQ ID NO: 6716 - protein, 40 aa, Artificial Sequence
  Description of Artificial Sequence: Synthetic polypeptide
EEYSAMRDQYMRTGEGFLCVFAINNTKSFEDIHHYREQIK

SEQ ID NO: 6717 - protein, 40 aa, Artificial Sequence
  Description of Artificial Sequence: Synthetic polypeptide
EYSAMRDQYMRTGEGFLCVFAINNTKSFEDIHHYREQIKR

SEQ ID NO: 6718 - protein, 40 aa, Artificial Sequence
  Description of Artificial Sequence: Synthetic polypeptide
YMRTGEGFLCVFAINNTKSFEDIHHYREQIKRVKDSEDVP

SEQ ID NO: 6719 - protein, 40 aa, Artificial Sequence
  Description of Artificial Sequence: Synthetic polypeptide
NNTKSFEDIHHYREQIKRVKDSEDVPMVLVGNKCDLPSRT

SEQ ID NO: 6720 - protein, 40 aa, Artificial Sequence
  Description of Artificial Sequence: Synthetic polypeptide
NTKSFEDIHHYREQIKRVKDSEDVPMVLVGNKCDLPSRTV

SEQ ID NO: 6721 - protein, 40 aa, Artificial Sequence
  Description of Artificial Sequence: Synthetic polypeptide
TKSFEDIHHYREQIKRVKDSEDVPMVLVGNKCDLPSRTVD

SEQ ID NO: 6722 - protein, 40 aa, Artificial Sequence
  Description of Artificial Sequence: Synthetic polypeptide
SFEDIHHYREQIKRVKDSEDVPMVLVGNKCDLPSRTVDTK

SEQ ID NO: 6723 - protein, 40 aa, Artificial Sequence
  Description of Artificial Sequence: Synthetic polypeptide
FEDIHHYREQIKRVKDSEDVPMVLVGNKCDLPSRTVDTKQ

SEQ ID NO: 6724 - protein, 40 aa, Artificial Sequence
  Description of Artificial Sequence: Synthetic polypeptide
EDIHHYREQIKRVKDSEDVPMVLVGNKCDLPSRTVDTKQA

SEQ ID NO: 6725 - protein, 40 aa, Artificial Sequence
  Description of Artificial Sequence: Synthetic polypeptide
DIHHYREQIKRVKDSEDVPMVLVGNKCDLPSRTVDTKQAQ

SEQ ID NO: 6726 - protein, 40 aa, Artificial Sequence
  Description of Artificial Sequence: Synthetic polypeptide
IHHYREQIKRVKDSEDVPMVLVGNKCDLPSRTVDTKQAQD

SEQ ID NO: 6727 - protein, 40 aa, Artificial Sequence
  Description of Artificial Sequence: Synthetic polypeptide
HHYREQIKRVKDSEDVPMVLVGNKCDLPSRTVDTKQAQDL

SEQ ID NO: 6728 - protein, 40 aa, Artificial Sequence
  Description of Artificial Sequence: Synthetic polypeptide
HYREQIKRVKDSEDVPMVLVGNKCDLPSRTVDTKQAQDLA

SEQ ID NO: 6729 - protein, 40 aa, Artificial Sequence
  Description of Artificial Sequence: Synthetic polypeptide
YREQIKRVKDSEDVPMVLVGNKCDLPSRTVDTKQAQDLAR

SEQ ID NO: 6730 - protein, 40 aa, Artificial Sequence
  Description of Artificial Sequence: Synthetic polypeptide
REQIKRVKDSEDVPMVLVGNKCDLPSRTVDTKQAQDLARS

SEQ ID NO: 6731 - protein, 40 aa, Artificial Sequence
  Description of Artificial Sequence: Synthetic polypeptide
EQIKRVKDSEDVPMVLVGNKCDLPSRTVDTKQAQDLARSY

SEQ ID NO: 6732 - protein, 40 aa, Artificial Sequence
  Description of Artificial Sequence: Synthetic polypeptide
QIKRVKDSEDVPMVLVGNKCDLPSRTVDTKQAQDLARSYG

SEQ ID NO: 6733 - protein, 40 aa, Artificial Sequence
  Description of Artificial Sequence: Synthetic polypeptide
IKRVKDSEDVPMVLVGNKCDLPSRTVDTKQAQDLARSYGI

SEQ ID NO: 6734 - protein, 40 aa, Artificial Sequence
  Description of Artificial Sequence: Synthetic polypeptide
SEDVPMVLVGNKCDLPSRTVDTKQAQDLARSYGIPFIETS

SEQ ID NO: 6735 - protein, 40 aa, Artificial Sequence
  Description of Artificial Sequence: Synthetic polypeptide
EDVPMVLVGNKCDLPSRTVDTKQAQDLARSYGIPFIETSA

SEQ ID NO: 6736 - protein, 40 aa, Artificial Sequence
  Description of Artificial Sequence: Synthetic polypeptide
MVLVGNKCDLPSRTVDTKQAQDLARSYGIPFIETSAKTRQ

SEQ ID NO: 6737 - protein, 40 aa, Artificial Sequence
  Description of Artificial Sequence: Synthetic polypeptide
LVGNKCDLPSRTVDTKQAQDLARSYGIPFIETSAKTRQRV

SEQ ID NO: 6738 - protein, 40 aa, Artificial Sequence
  Description of Artificial Sequence: Synthetic polypeptide
SRTVDTKQAQDLARSYGIPFIETSAKTRQRVEDAFYTLVR

SEQ ID NO: 6739 - protein, 40 aa, Artificial Sequence
  Description of Artificial Sequence: Synthetic polypeptide
AQDLARSYGIPFIETSAKTRQGVDDAFYTLVREIRKHKEK

SEQ ID NO: 6740 - protein, 40 aa, Artificial Sequence
  Description of Artificial Sequence: Synthetic polypeptide
DLARSYGIPFIETSAKTRQGVDDAFYTLVREIRKHKEKMS

SEQ ID NO: 6741 - protein, 40 aa, Artificial Sequence
  Description of Artificial Sequence: Synthetic polypeptide
ARSYGIPFIETSAKTRQGVDDAFYTLVREIRKHKEKMSKD

SEQ ID NO: 6742 - protein, 40 aa, Artificial Sequence
  Description of Artificial Sequence: Synthetic polypeptide
YGIPFIETSAKTRQRVEDAFYTLVREIRQYRLKKISKEEK

SEQ ID NO: 6743 - protein, 40 aa, Artificial Sequence
  Description of Artificial Sequence: Synthetic polypeptide
YGIPFIETSAKTRQGVDDAFYTLVREIRKHKEKMSKDGKK

SEQ ID NO: 6744 - protein, 40 aa, Artificial Sequence
  Description of Artificial Sequence: Synthetic polypeptide
GIPFIETSAKTRQRVEDAFYTLVREIRQYRLKKISKEEKT

SEQ ID NO: 6745 - protein, 40 aa, Artificial Sequence
  Description of Artificial Sequence: Synthetic polypeptide
GIPFIETSAKTRQGVDDAFYTLVREIRKHKEKMSKDGKKK

SEQ ID NO: 6746 - protein, 40 aa, Artificial Sequence
  Description of Artificial Sequence: Synthetic polypeptide
IPFIETSAKTRQGVDDAFYTLVREIRKHKEKMSKDGKKKK

SEQ ID NO: 6747 - protein, 40 aa, Artificial Sequence
  Description of Artificial Sequence: Synthetic polypeptide
FIETSAKTRQRVEDAFYTLVREIRQYRLKKISKEEKTPGC

SEQ ID NO: 6748 - protein, 40 aa, Artificial Sequence
  Description of Artificial Sequence: Synthetic polypeptide
FIETSAKTRQGVDDAFYTLVREIRKHKEKMSKDGKKKKKK

SEQ ID NO: 6749 - protein, 40 aa, Artificial Sequence
  Description of Artificial Sequence: Synthetic polypeptide
IETSAKTRQRVEDAFYTLVREIRQYRLKKISKEEKTPGCV

SEQ ID NO: 6750 - protein, 40 aa, Artificial Sequence
  Description of Artificial Sequence: Synthetic polypeptide
TSAKTRQRVEDAFYTLVREIRQYRLKKISKEEKTPGCVKI

SEQ ID NO: 6751 - protein, 40 aa, Artificial Sequence
  Description of Artificial Sequence: Synthetic polypeptide
SAKTRQGVDDAFYTLVREIRKHKEKMSKDGKKKKKKSKTK

SEQ ID NO: 6752 - protein, 40 aa, Artificial Sequence
  Description of Artificial Sequence: Synthetic polypeptide
AKTRQGVDDAFYTLVREIRKHKEKMSKDGKKKKKKSKTKC

SEQ ID NO: 6753 - protein, 40 aa, Artificial Sequence
  Description of Artificial Sequence: Synthetic polypeptide
TRQRVEDAFYTLVREIRQYRLKKISKEEKTPGCVKIKKCI

SEQ ID NO: 6754 - protein, 40 aa, Artificial Sequence
  Description of Artificial Sequence: Synthetic polypeptide
TEYKLVVVGADGVGKSALTIQLIQNHFVDEYDPTIEDSYR

SEQ ID NO: 6755 - protein, 40 aa, Artificial Sequence
  Description of Artificial Sequence: Synthetic polypeptide
EYKLVVVGADGVGKSALTIQLIQNHFVDEYDPTIEDSYRK

SEQ ID NO: 6756 - protein, 40 aa, Artificial Sequence
  Description of Artificial Sequence: Synthetic polypeptide
TEYKLVVVGASGVGKSALTIQLIQNHFVDEYDPTIEDSYR

SEQ ID NO: 6757 - protein, 40 aa, Artificial Sequence
  Description of Artificial Sequence: Synthetic polypeptide
VVGAVGVGKSALTIQLIQNHFVDEYDPTIEDSYRKQVVID

SEQ ID NO: 6758 - protein, 40 aa, Artificial Sequence
  Description of Artificial Sequence: Synthetic polypeptide
TEYKLVVVGAGCVGKSALTIQLIQNHFVDEYDPTIEDSYR

SEQ ID NO: 6759 - protein, 40 aa, Artificial Sequence
  Description of Artificial Sequence: Synthetic polypeptide
EYKLVVVGAGCVGKSALTIQLIQNHFVDEYDPTIEDSYRK

SEQ ID NO: 6760 - protein, 40 aa, Artificial Sequence
  Description of Artificial Sequence: Synthetic polypeptide
YKLVVVGAGCVGKSALTIQLIQNHFVDEYDPTIEDSYRKQ

SEQ ID NO: 6761 - protein, 40 aa, Artificial Sequence
  Description of Artificial Sequence: Synthetic polypeptide
TEYKLVVVGAGDVGKSALTIQLIQNHFVDEYDPTIEDSYR

SEQ ID NO: 6762 - protein, 40 aa, Artificial Sequence
  Description of Artificial Sequence: Synthetic polypeptide
EYKLVVVGAGDVGKSALTIQLIQNHFVDEYDPTIEDSYRK

SEQ ID NO: 6763 - protein, 40 aa, Artificial Sequence
  Description of Artificial Sequence: Synthetic polypeptide
KLVVVGAGDVGKSALTIQLIQNHFVDEYDPTIEDSYRKQV

SEQ ID NO: 6764 - protein, 40 aa, Artificial Sequence
  Description of Artificial Sequence: Synthetic polypeptide
LIQNHFVDEYDPTIEDSYRKQVVIDGETCLLDILDTAGHE

SEQ ID NO: 6765 - protein, 40 aa, Artificial Sequence
  Description of Artificial Sequence: Synthetic polypeptide
IQNHFVDEYDPTIEDSYRKQVVIDGETCLLDILDTAGHEE

SEQ ID NO: 6766 - protein, 40 aa, Artificial Sequence
  Description of Artificial Sequence: Synthetic polypeptide
PTIEDSYRKQVVIDGETCLLDILDTAGHEEYSAMRDQYMR

SEQ ID NO: 6767 - protein, 40 aa, Artificial Sequence
  Description of Artificial Sequence: Synthetic polypeptide
DILDTAGHEEYSAMRDQYMRTGEGFLCVFAINNTKSFEDI

SEQ ID NO: 6768 - protein, 40 aa, Artificial Sequence
  Description of Artificial Sequence: Synthetic polypeptide
GHEEYSAMRDQYMRTGEGFLCVFAINNTKSFEDIHHYREQ

SEQ ID NO: 6769 - protein, 40 aa, Artificial Sequence
  Description of Artificial Sequence: Synthetic polypeptide
HEEYSAMRDQYMRTGEGFLCVFAINNTKSFEDIHHYREQI

SEQ ID NO: 6770 - protein, 40 aa, Artificial Sequence; identical to SEQ ID NO: 1006
  Description of Artificial Sequence: Synthetic polypeptide

SEQ ID NO: 6771 - protein, 40 aa, Artificial Sequence; identical to SEQ ID NO: 1007
  Description of Artificial Sequence: Synthetic polypeptide

SEQ ID NO: 6772 - protein, 40 aa, Artificial Sequence; identical to SEQ ID NO: 1008
  Description of Artificial Sequence: Synthetic polypeptide

SEQ ID NO: 6773 - protein, 40 aa, Artificial Sequence; identical to SEQ ID NO: 1009
  Description of Artificial Sequence: Synthetic polypeptide

SEQ ID NO: 6774 - protein, 40 aa, Artificial Sequence; identical to SEQ ID NO: 3192
  Description of Artificial Sequence: Synthetic polypeptide

SEQ ID NO: 6775 - protein, 40 aa, Artificial Sequence; identical to SEQ ID NO: 1010
  Description of Artificial Sequence: Synthetic polypeptide

SEQ ID NO: 6776 - protein, 40 aa, Artificial Sequence
  Description of Artificial Sequence: Synthetic polypeptide
DEYDPTIEDSYRKQVVIDGETCLLDILDTAGKEEYSAMRD

SEQ ID NO: 6777 - protein, 40 aa, Artificial Sequence
  Description of Artificial Sequence: Synthetic polypeptide
YDPTIEDSYRKQVVIDGETCLLDILDTAGKEEYSAMRDQY

SEQ ID NO: 6778 - protein, 40 aa, Artificial Sequence; identical to SEQ ID NO: 3224
  Description of Artificial Sequence: Synthetic polypeptide

SEQ ID NO: 6779 - protein, 40 aa, Artificial Sequence; identical to SEQ ID NO: 2714
  Description of Artificial Sequence: Synthetic polypeptide

SEQ ID NO: 6780 - protein, 40 aa, Artificial Sequence
  Description of Artificial Sequence: Synthetic polypeptide
YRKQVVIDGETCLLDILDTAGKEEYSAMRDQYMRTGEGFL

SEQ ID NO: 6781 - protein, 40 aa, Artificial Sequence; identical to SEQ ID NO: 1013
  Description of Artificial Sequence: Synthetic polypeptide

SEQ ID NO: 6782 - protein, 40 aa, Artificial Sequence; identical to SEQ ID NO: 1014
  Description of Artificial Sequence: Synthetic polypeptide

SEQ ID NO: 6783 - protein, 40 aa, Artificial Sequence; identical to SEQ ID NO: 1016
  Description of Artificial Sequence: Synthetic polypeptide

SEQ ID NO: 6784 - protein, 40 aa, Artificial Sequence
  Description of Artificial Sequence: Synthetic polypeptide
IDGETCLLDILDTAGKEEYSAMRDQYMRTGEGFLCVFAIN

SEQ ID NO: 6785 - protein, 40 aa, Artificial Sequence
  Description of Artificial Sequence: Synthetic polypeptide
GETCLLDILDTAGKEEYSAMRDQYMRTGEGFLCVFAINNT

SEQ ID NO: 6786 - protein, 40 aa, Artificial Sequence
  Description of Artificial Sequence: Synthetic polypeptide
ETCLLDILDTAGKEEYSAMRDQYMRTGEGFLCVFAINNTK

SEQ ID NO: 6787 - protein, 40 aa, Artificial Sequence
  Description of Artificial Sequence: Synthetic polypeptide
TCLLDILDTAGKEEYSAMRDQYMRTGEGFLCVFAINNTKS

SEQ ID NO: 6788 - protein, 40 aa, Artificial Sequence; identical to SEQ ID NO: 1019
  Description of Artificial Sequence: Synthetic polypeptide

SEQ ID NO: 6789 - protein, 40 aa, Artificial Sequence
  Description of Artificial Sequence: Synthetic polypeptide
DILDTAGKEEYSAMRDQYMRTGEGFLCVFAINNTKSFEDI

SEQ ID NO: 6790 - protein, 40 aa, Artificial Sequence; identical to SEQ ID NO: 1020
  Description of Artificial Sequence: Synthetic polypeptide

SEQ ID NO: 6791 - protein, 40 aa, Artificial Sequence
  Description of Artificial Sequence: Synthetic polypeptide
LDTAGKEEYSAMRDQYMRTGEGFLCVFAINNTKSFEDIHH

SEQ ID NO: 6792 - protein, 40 aa, Artificial Sequence; identical to SEQ ID NO: 1021
  Description of Artificial Sequence: Synthetic polypeptide

SEQ ID NO: 6793 - protein, 40 aa, Artificial Sequence; identical to SEQ ID NO: 1022
  Description of Artificial Sequence: Synthetic polypeptide

SEQ ID NO: 6794 - protein, 40 aa, Artificial Sequence; identical to SEQ ID NO: 1023
  Description of Artificial Sequence: Synthetic polypeptide

SEQ ID NO: 6795 - protein, 40 aa, Artificial Sequence
  Description of Artificial Sequence: Synthetic polypeptide
YRKQVVIDGETCLLDILDTAGLEEYSAMRDQYMRTGEGFL

SEQ ID NO: 6796 - protein, 40 aa, Artificial Sequence
  Description of Artificial Sequence: Synthetic polypeptide
LLDILDTAGLEEYSAMRDQYMRTGEGFLCVFAINNTKSFE

SEQ ID NO: 6797 - protein, 40 aa, Artificial Sequence
  Description of Artificial Sequence: Synthetic polypeptide
DTAGLEEYSAMRDQYMRTGEGFLCVFAINNTKSFEDIHHY

SEQ ID NO: 6798 - protein, 40 aa, Artificial Sequence
  Description of Artificial Sequence: Synthetic polypeptide
TAGLEEYSAMRDQYMRTGEGFLCVFAINNTKSFEDIHHYR

SEQ ID NO: 6799 - protein, 40 aa, Artificial Sequence
  Description of Artificial Sequence: Synthetic polypeptide
AGLEEYSAMRDQYMRTGEGFLCVFAINNTKSFEDIHHYRE

SEQ ID NO: 6800 - protein, 40 aa, Artificial Sequence
  Description of Artificial Sequence: Synthetic polypeptide
GLEEYSAMRDQYMRTGEGFLCVFAINNTKSFEDIHHYREQ

SEQ ID NO: 6801 - protein, 40 aa, Artificial Sequence
  Description of Artificial Sequence: Synthetic polypeptide
LEEYSAMRDQYMRTGEGFLCVFAINNTKSFEDIHHYREQI

SEQ ID NO: 6802 - protein, 40 aa, Artificial Sequence; identical to SEQ ID NO: 2716
  Description of Artificial Sequence: Synthetic polypeptide

SEQ ID NO: 6803 - protein, 40 aa, Artificial Sequence
  Description of Artificial Sequence: Synthetic polypeptide
DTAGREEYSAMRDQYMRTGEGFLCVFAINNTKSFEDIHHY

SEQ ID NO: 6804 - protein, 40 aa, Artificial Sequence; identical to SEQ ID NO: 1031
  Description of Artificial Sequence: Synthetic polypeptide

SEQ ID NO: 6805 - protein, 40 aa, Artificial Sequence; identical to SEQ ID NO: 1032
  Description of Artificial Sequence: Synthetic polypeptide

SEQ ID NO: 6806 - protein, 40 aa, Artificial Sequence
  Description of Artificial Sequence: Synthetic polypeptide
KKKPTPIQLNPAPDGSAVNGTSSAETNLEALQKKLEELEL

SEQ ID NO: 6807 - protein, 40 aa, Artificial Sequence
  Description of Artificial Sequence: Synthetic polypeptide
PTPIQLNPAPDGSAVNGTSSAETNLEALQKKLEELELDEQ

SEQ ID NO: 6808 - protein, 40 aa, Artificial Sequence
  Description of Artificial Sequence: Synthetic polypeptide
NPAPDGSAVNGTSSAETNLEALQKKLEELELDEQQRKRLE

SEQ ID NO: 6809 - protein, 40 aa, Artificial Sequence
  Description of Artificial Sequence: Synthetic polypeptide
APDGSAVNGTSSAETNLEALQKKLEELELDEQQRKRLEAF

SEQ ID NO: 6810 - protein, 40 aa, Artificial Sequence
  Description of Artificial Sequence: Synthetic polypeptide
DGSAVNGTSSAETNLEALQKKLEELELDEQQRKRLEAFLT

SEQ ID NO: 6811 - protein, 40 aa, Artificial Sequence
  Description of Artificial Sequence: Synthetic polypeptide
GTSSAETNLEALQKKLEELELDEQQRKRLEAFLTQKQKVG

SEQ ID NO: 6812 - protein, 40 aa, Artificial Sequence
  Description of Artificial Sequence: Synthetic polypeptide
SSAETNLEALQKKLEELELDEQQRKRLEAFLTQKQKVGEL

SEQ ID NO: 6813 - protein, 40 aa, Artificial Sequence
  Description of Artificial Sequence: Synthetic polypeptide
SAETNLEALQKKLEELELDEQQRKRLEAFLTQKQKVGELK

SEQ ID NO: 6814 - protein, 40 aa, Artificial Sequence
  Description of Artificial Sequence: Synthetic polypeptide
NLEALQKKLEELELDEQQRKRLEAFLTQKQKVGELKDDDF

SEQ ID NO: 6815 - protein, 40 aa, Artificial Sequence
  Description of Artificial Sequence: Synthetic polypeptide
EELELDEQQRKRLEAFLTQKQKVGELKDDDFEKISELGAG

SEQ ID NO: 6816 - protein, 40 aa, Artificial Sequence
  Description of Artificial Sequence: Synthetic polypeptide
MEIKPAIRNQIIRELQVLHECNSPYIVGFYGAFYSDGEIS

SEQ ID NO: 6817 - protein, 40 aa, Artificial Sequence
  Description of Artificial Sequence: Synthetic polypeptide
EIKPAIRNQIIRELQVLHECNSPYIVGFYGAFYSDGEISI

SEQ ID NO: 6818 - protein, 40 aa, Artificial Sequence
  Description of Artificial Sequence: Synthetic polypeptide
NSPYIVGFYGAFYSDGEISICMEHMDGGSLDQVLKKAGRI

SEQ ID NO: 6819 - protein, 40 aa, Artificial Sequence
  Description of Artificial Sequence: Synthetic polypeptide
DGEISICMEHMDGGSLDQVLKKAGRIPEQILGKVSIAVIK

SEQ ID NO: 6820 - protein, 40 aa, Artificial Sequence
  Description of Artificial Sequence: Synthetic polypeptide
EISICMEHMDGGSLDQVLKKAGRIPEQILGKVSIAVIKGL

SEQ ID NO: 6821 - protein, 40 aa, Artificial Sequence
  Description of Artificial Sequence: Synthetic polypeptide
HMDGGSLDQVLKKAGRIPEQILGKVSIAVIKGLTYLREKH

SEQ ID NO: 6822 - protein, 40 aa, Artificial Sequence
  Description of Artificial Sequence: Synthetic polypeptide
GGSLDQVLKKAGRIPEQILGKVSIAVIKGLTYLREKHKIM

SEQ ID NO: 6823 - protein, 40 aa, Artificial Sequence
  Description of Artificial Sequence: Synthetic polypeptide
SYMSPERLQGTHYSVQSDIWSMGLSLVEMAVGRYPIPPPD

SEQ ID NO: 6824 - protein, 40 aa, Artificial Sequence
  Description of Artificial Sequence: Synthetic polypeptide
GLSLVEMAVGRYPIPPPDAKELELMFGCQVEGDAAETPPR

SEQ ID NO: 6825 - protein, 40 aa, Artificial Sequence
  Description of Artificial Sequence: Synthetic polypeptide
GMDSRPPMAIFELLDYIVNEPPPKLPSGVFSLEFQDFVNK

SEQ ID NO: 6826 - protein, 40 aa, Artificial Sequence
  Description of Artificial Sequence: Synthetic polypeptide
PPMAIFELLDYIVNEPPPKLPSGVFSLEFQDFVNKCLIKN

SEQ ID NO: 6827 - protein, 40 aa, Artificial Sequence
  Description of Artificial Sequence: Synthetic polypeptide
PMAIFELLDYIVNEPPPKLPSGVFSLEFQDFVNKCLIKNP

SEQ ID NO: 6828 - protein, 40 aa, Artificial Sequence
  Description of Artificial Sequence: Synthetic polypeptide
MAIFELLDYIVNEPPPKLPSGVFSLEFQDFVNKCLIKNPA

SEQ ID NO: 6829 - protein, 40 aa, Artificial Sequence
  Description of Artificial Sequence: Synthetic polypeptide
FELLDYIVNEPPPKLPSGVFSLEFQDFVNKCLIKNPAERA

SEQ ID NO: 6830 - protein, 40 aa, Artificial Sequence
  Description of Artificial Sequence: Synthetic polypeptide
MDYIVNEPPPKLPSGVFSLEFQDFVNKCLIKNPAERADLK

SEQ ID NO: 6831 - protein, 40 aa, Artificial Sequence
  Description of Artificial Sequence: Synthetic polypeptide
DYIVNEPPPKLPSGVFSLEFQDFVNKCLIKNPAERADLKQ

SEQ ID NO: 6832 - protein, 40 aa, Artificial Sequence
  Description of Artificial Sequence: Synthetic polypeptide
IVNEPPPKLPSGVFSLEFQDFVNKCLIKNPAERADLKQLM

SEQ ID NO: 6833 - protein, 40 aa, Artificial Sequence
  Description of Artificial Sequence: Synthetic polypeptide
VNEPPPKLPSGVFSLEFQDFVNKCLIKNPAERADLKQLMV

SEQ ID NO: 6834 - protein, 40 aa, Artificial Sequence
  Description of Artificial Sequence: Synthetic polypeptide
NEPPPKLPSGVFSLEFQDFVNKCLIKNPAERADLKQLMVH

SEQ ID NO: 6835 - protein, 40 aa, Artificial Sequence
  Description of Artificial Sequence: Synthetic polypeptide
EPPPKLPSGVFSLEFQDFVNKCLIKNPAERADLKQLMVHA

SEQ ID NO: 6836 - protein, 40 aa, Artificial Sequence
  Description of Artificial Sequence: Synthetic polypeptide
PPPKLPSGVFSLEFQDFVNKCLIKNPAERADLKQLMVHAF

SEQ ID NO: 6837 - protein, 40 aa, Artificial Sequence
  Description of Artificial Sequence: Synthetic polypeptide
PPKLPSGVFSLEFQDFVNKCLIKNPAERADLKQLMVHAFI

SEQ ID NO: 6838 - protein, 40 aa, Artificial Sequence
  Description of Artificial Sequence: Synthetic polypeptide
PSGVFSLEFQDFVNKCLIKNPAERADLKQLMVHAFIKRSD

SEQ ID NO: 6839 - protein, 40 aa, Artificial Sequence
  Description of Artificial Sequence: Synthetic polypeptide
GVFSLEFQDFVNKCLIKNPAERADLKQLMVHAFIKRSDAE

SEQ ID NO: 6840 - protein, 40 aa, Artificial Sequence
  Description of Artificial Sequence: Synthetic polypeptide
VFSLEFQDFVNKCLIKNPAERADLKQLMVHAFIKRSDAEE

SEQ ID NO: 6841 - protein, 40 aa, Artificial Sequence
  Description of Artificial Sequence: Synthetic polypeptide
FSLEFQDFVNKCLIKNPAERADLKQLMVHAFIKRSDAEEV

SEQ ID NO: 6842 - protein, 40 aa, Artificial Sequence
  Description of Artificial Sequence: Synthetic polypeptide
SLEFQDFVNKCLIKNPAERADLKQLMVHAFIKRSDAEEVD

SEQ ID NO: 6843 - protein, 40 aa, Artificial Sequence
  Description of Artificial Sequence: Synthetic polypeptide
MEFQDFVNKCLIKNPAERADLKQLMVHAFIKRSDAEEVDF

SEQ ID NO: 6844 - protein, 40 aa, Artificial Sequence
  Description of Artificial Sequence: Synthetic polypeptide
FQDFVNKCLIKNPAERADLKQLMVHAFIKRSDAEEVDFAG

SEQ ID NO: 6845 - protein, 40 aa, Artificial Sequence
  Description of Artificial Sequence: Synthetic polypeptide
DFVNKCLIKNPAERADLKQLMVHAFIKRSDAEEVDFAGWL

SEQ ID NO: 6846 - protein, 40 aa, Artificial Sequence
  Description of Artificial Sequence: Synthetic polypeptide
FVNKCLIKNPAERADLKQLMVHAFIKRSDAEEVDFAGWLC

SEQ ID NO: 6847 - protein, 40 aa, Artificial Sequence
  Description of Artificial Sequence: Synthetic polypeptide
VNKCLIKNPAERADLKQLMVHAFIKRSDAEEVDFAGWLCS

SEQ ID NO: 6848 - protein, 40 aa, Artificial Sequence
  Description of Artificial Sequence: Synthetic polypeptide
NKCLIKNPAERADLKQLMVHAFIKRSDAEEVDFAGWLCST

SEQ ID NO: 6849 - protein, 40 aa, Artificial Sequence
  Description of Artificial Sequence: Synthetic polypeptide
ATEYIQYMRRKNHTHQQDIDDLKRQNALLEQQVRALEKAR

SEQ ID NO: 6850 - protein, 40 aa, Artificial Sequence
  Description of Artificial Sequence: Synthetic polypeptide
TNYPSSDNSLYTNAKGSTISAFDGGSDSSSESEPEEPQSR

SEQ ID NO: 6851 - protein, 40 aa, Artificial Sequence
  Description of Artificial Sequence: Synthetic polypeptide
PSSDNSLYTNAKGSTISAFDGGSDSSSESEPEEPQSRKKL

SEQ ID NO: 6852 - protein, 40 aa, Artificial Sequence
  Description of Artificial Sequence: Synthetic polypeptide
CNTNMSVPTDGAVTTSQIPASEQETLVRPKPLLLKLLKSV

SEQ ID NO: 6853 - protein, 40 aa, Artificial Sequence
  Description of Artificial Sequence: Synthetic polypeptide
QIPASEQETLVRPKPLLLKLLKSVGAQKDTYTMKEVLFYL

SEQ ID NO: 6854 - protein, 40 aa, Artificial Sequence
  Description of Artificial Sequence: Synthetic polypeptide
LLKLLKSVGAQKDTYTMKEVLFYLGQYIMTKRLYDEKQQH

SEQ ID NO: 6855 - protein, 40 aa, Artificial Sequence
  Description of Artificial Sequence: Synthetic polypeptide
VGAQKDTYTMKEVLFYLGQYIMTKRLYDEKQQHIVYCSND

SEQ ID NO: 6856 - protein, 40 aa, Artificial Sequence
  Description of Artificial Sequence: Synthetic polypeptide
GAQKDTYTMKEVLFYLGQYIMTKRLYDEKQQHIVYCSNDL

SEQ ID NO: 6857 - protein, 40 aa, Artificial Sequence
  Description of Artificial Sequence: Synthetic polypeptide
LFYLGQYIMTKRLYDEKQQHIVYCSNDLLGDLFGVPSFSV

SEQ ID NO: 6858 - protein, 40 aa, Artificial Sequence
  Description of Artificial Sequence: Synthetic polypeptide
FYLGQYIMTKRLYDEKQQHIVYCSNDLLGDLFGVPSFSVK

SEQ ID NO: 6859 - protein, 40 aa, Artificial Sequence
  Description of Artificial Sequence: Synthetic polypeptide
YLGQYIMTKRLYDEKQQHIVYCSNDLLGDLFGVPSFSVKE

SEQ ID NO: 6860 - protein, 40 aa, Artificial Sequence
  Description of Artificial Sequence: Synthetic polypeptide
GQYIMTKRLYDEKQQHIVYCSNDLLGDLFGVPSFSVKEHR

SEQ ID NO: 6861 - protein, 40 aa, Artificial Sequence
  Description of Artificial Sequence: Synthetic polypeptide
YIMTKRLYDEKQQHIVYCSNDLLGDLFGVPSFSVKEHRKI

SEQ ID NO: 6862 - protein, 40 aa, Artificial Sequence
  Description of Artificial Sequence: Synthetic polypeptide
IMTKRLYDEKQQHIVYCSNDLLGDLFGVPSFSVKEHRKIY

SEQ ID NO: 6863 - protein, 40 aa, Artificial Sequence
  Description of Artificial Sequence: Synthetic polypeptide
MTKRLYDEKQQHIVYCSNDLLGDLFGVPSFSVKEHRKIYT

SEQ ID NO: 6864 - protein, 40 aa, Artificial Sequence
  Description of Artificial Sequence: Synthetic polypeptide
TKRLYDEKQQHIVYCSNDLLGDLFGVPSFSVKEHRKIYTM

SEQ ID NO: 6865 - protein, 40 aa, Artificial Sequence
  Description of Artificial Sequence: Synthetic polypeptide
KRLYDEKQQHIVYCSNDLLGDLFGVPSFSVKEHRKIYTMI

SEQ ID NO: 6866 - protein, 40 aa, Artificial Sequence
  Description of Artificial Sequence: Synthetic polypeptide
DEKQQHIVYCSNDLLGDLFGVPSFSVKEHRKIYTMIYRNL

SEQ ID NO: 6867 - protein, 40 aa, Artificial Sequence
  Description of Artificial Sequence: Synthetic polypeptide
KQQHIVYCSNDLLGDLFGVPSFSVKEHRKIYTMIYRNLVV

SEQ ID NO: 6868 - protein, 40 aa, Artificial Sequence
  Description of Artificial Sequence: Synthetic polypeptide
QHIVYCSNDLLGDLFGVPSFSVKEHRKIYTMIYRNLVVVN

SEQ ID NO: 6869 - protein, 40 aa, Artificial Sequence
  Description of Artificial Sequence: Synthetic polypeptide
IVYCSNDLLGDLFGVPSFSVKEHRKIYTMIYRNLVVVNQQ

SEQ ID NO: 6870 - protein, 40 aa, Artificial Sequence
  Description of Artificial Sequence: Synthetic polypeptide
VYCSNDLLGDLFGVPSFSVKEHRKIYTMIYRNLVVVNQQE

SEQ ID NO: 6871 - protein, 40 aa, Artificial Sequence
  Description of Artificial Sequence: Synthetic polypeptide
LLGDLFGVPSFSVKEHRKIYTMIYRNLVVVNQQESSDSGT

SEQ ID NO: 6872 - protein, 40 aa, Artificial Sequence
  Description of Artificial Sequence: Synthetic polypeptide
GDLFGVPSFSVKEHRKIYTMIYRNLVVVNQQESSDSGTSV

SEQ ID NO: 6873 - protein, 40 aa, Artificial Sequence
  Description of Artificial Sequence: Synthetic polypeptide
DLFGVPSFSVKEHRKIYTMIYRNLVVVNQQESSDSGTSVS

SEQ ID NO: 6874 - protein, 40 aa, Artificial Sequence
  Description of Artificial Sequence: Synthetic polypeptide
FGVPSFSVKEHRKIYTMIYRNLVVVNQQESSDSGTSVSEN

SEQ ID NO: 6875 - protein, 40 aa, Artificial Sequence
  Description of Artificial Sequence: Synthetic polypeptide
PSFSVKEHRKIYTMIYRNLVVVNQQESSDSGTSVSENRCH

SEQ ID NO: 6876 - protein, 40 aa, Artificial Sequence
  Description of Artificial Sequence: Synthetic polypeptide
VKEHRKIYTMIYRNLVVVNQQESSDSGTSVSENRCHLEGG

SEQ ID NO: 6877 - protein, 40 aa, Artificial Sequence
  Description of Artificial Sequence: Synthetic polypeptide
IYRNLVVVNQQESSDSGTSVSENRCHLEGGSDQKDLVQEL

SEQ ID NO: 6878 - protein, 40 aa, Artificial Sequence
  Description of Artificial Sequence: Synthetic polypeptide
RNLVVVNQQESSDSGTSVSENRCHLEGGSDQKDLVQELQE

SEQ ID NO: 6879 - protein, 40 aa, Artificial Sequence
  Description of Artificial Sequence: Synthetic polypeptide
NQQESSDSGTSVSENRCHLEGGSDQKDLVQELQEEKPSSS

SEQ ID NO: 6880 - protein, 40 aa, Artificial Sequence
  Description of Artificial Sequence: Synthetic polypeptide
ESSDSGTSVSENRCHLEGGSDQKDLVQELQEEKPSSSHLV

SEQ ID NO: 6881 - protein, 40 aa, Artificial Sequence
  Description of Artificial Sequence: Synthetic polypeptide
SENRCHLEGGSDQKDLVQELQEEKPSSSHLVSRPSTSSRR

SEQ ID NO: 6882 - protein, 40 aa, Artificial Sequence
  Description of Artificial Sequence: Synthetic polypeptide
LEGGSDQKDLVQELQEEKPSSSHLVSRPSTSSRRRAISET

SEQ ID NO: 6883 - protein, 40 aa, Artificial Sequence
  Description of Artificial Sequence: Synthetic polypeptide
SDQKDLVQELQEEKPSSSHLVSRPSTSSRRRAISETEENS

SEQ ID NO: 6884 - protein, 40 aa, Artificial Sequence
  Description of Artificial Sequence: Synthetic polypeptide
QELQEEKPSSSHLVSRPSTSSRRRAISETEENSDELSGER

SEQ ID NO: 6885 - protein, 40 aa, Artificial Sequence
  Description of Artificial Sequence: Synthetic polypeptide
AISETEENSDELSGERQRKRHKSDSISLSFDESLALCVIR

SEQ ID NO: 6886 - protein, 40 aa, Artificial Sequence
  Description of Artificial Sequence: Synthetic polypeptide
ENSDELSGERQRKRHKSDSISLSFDESLALCVIREICCER

SEQ ID NO: 6887 - protein, 40 aa, Artificial Sequence
  Description of Artificial Sequence: Synthetic polypeptide
LSGERQRKRHKSDSISLSFDESLALCVIREICCERSSSSE

SEQ ID NO: 6888 - protein, 40 aa, Artificial Sequence
  Description of Artificial Sequence: Synthetic polypeptide
HKSDSISLSFDESLALCVIREICCERSSSSESTGTPSNPD

SEQ ID NO: 6889 - protein, 40 aa, Artificial Sequence
  Description of Artificial Sequence: Synthetic polypeptide
SLSFDESLALCVIREICCERSSSSESTGTPSNPDLDAGVS

SEQ ID NO: 6890 - protein, 40 aa, Artificial Sequence
  Description of Artificial Sequence: Synthetic polypeptide
ESLALCVIREICCERSSSSESTGTPSNPDLDAGVSEHSGD

SEQ ID NO: 6891 - protein, 40 aa, Artificial Sequence
  Description of Artificial Sequence: Synthetic polypeptide
MALCVIREICCERSSSSESTGTPSNPDLDAGVSEHSGDWL

SEQ ID NO: 6892 - protein, 40 aa, Artificial Sequence
  Description of Artificial Sequence: Synthetic polypeptide
ALCVIREICCERSSSSESTGTPSNPDLDAGVSEHSGDWLD

SEQ ID NO: 6893 - protein, 40 aa, Artificial Sequence
  Description of Artificial Sequence: Synthetic polypeptide
VIREICCERSSSSESTGTPSNPDLDAGVSEHSGDWLDQDS

SEQ ID NO: 6894 - protein, 40 aa, Artificial Sequence
  Description of Artificial Sequence: Synthetic polypeptide
CERSSSSESTGTPSNPDLDAGVSEHSGDWLDQDSVSDQFS

SEQ ID NO: 6895 - protein, 40 aa, Artificial Sequence
  Description of Artificial Sequence: Synthetic polypeptide
RSSSSESTGTPSNPDLDAGVSEHSGDWLDQDSVSDQFSVE

SEQ ID NO: 6896 - protein, 40 aa, Artificial Sequence
  Description of Artificial Sequence: Synthetic polypeptide
SSSSESTGTPSNPDLDAGVSEHSGDWLDQDSVSDQFSVEF

SEQ ID NO: 6897 - protein, 40 aa, Artificial Sequence
  Description of Artificial Sequence: Synthetic polypeptide
SSESTGTPSNPDLDAGVSEHSGDWLDQDSVSDQFSVEFEV

SEQ ID NO: 6898 - protein, 40 aa, Artificial Sequence
  Description of Artificial Sequence: Synthetic polypeptide
SESTGTPSNPDLDAGVSEHSGDWLDQDSVSDQFSVEFEVE

SEQ ID NO: 6899 - protein, 40 aa, Artificial Sequence
  Description of Artificial Sequence: Synthetic polypeptide
STGTPSNPDLDAGVSEHSGDWLDQDSVSDQFSVEFEVESL

SEQ ID NO: 6900 - protein, 40 aa, Artificial Sequence
  Description of Artificial Sequence: Synthetic polypeptide
TGTPSNPDLDAGVSEHSGDWLDQDSVSDQFSVEFEVESLD

SEQ ID NO: 6901 - protein, 40 aa, Artificial Sequence
  Description of Artificial Sequence: Synthetic polypeptide
SNPDLDAGVSEHSGDWLDQDSVSDQFSVEFEVESLDSEDY

SEQ ID NO: 6902 - protein, 40 aa, Artificial Sequence
  Description of Artificial Sequence: Synthetic polypeptide
NPDLDAGVSEHSGDWLDQDSVSDQFSVEFEVESLDSEDYS

SEQ ID NO: 6903 - protein, 40 aa, Artificial Sequence
  Description of Artificial Sequence: Synthetic polypeptide
PDLDAGVSEHSGDWLDQDSVSDQFSVEFEVESLDSEDYSL

SEQ ID NO: 6904 - protein, 40 aa, Artificial Sequence
  Description of Artificial Sequence: Synthetic polypeptide
DLDAGVSEHSGDWLDQDSVSDQFSVEFEVESLDSEDYSLS

SEQ ID NO: 6905 - protein, 40 aa, Artificial Sequence
  Description of Artificial Sequence: Synthetic polypeptide
GVSEHSGDWLDQDSVSDQFSVEFEVESLDSEDYSLSEEGQ

SEQ ID NO: 6906 - protein, 40 aa, Artificial Sequence
  Description of Artificial Sequence: Synthetic polypeptide
HSGDWLDQDSVSDQFSVEFEVESLDSEDYSLSEEGQELSD

SEQ ID NO: 6907 - protein, 40 aa, Artificial Sequence
  Description of Artificial Sequence: Synthetic polypeptide
DSVSDQFSVEFEVESLDSEDYSLSEEGQELSDEDDEVYQV

SEQ ID NO: 6908 - protein, 40 aa, Artificial Sequence
  Description of Artificial Sequence: Synthetic polypeptide
QFSVEFEVESLDSEDYSLSEEGQELSDEDDEVYQVTVYQA

SEQ ID NO: 6909 - protein, 40 aa, Artificial Sequence
  Description of Artificial Sequence: Synthetic polypeptide
ALRENWLPEDKGKDKGEISEKAKLENSTQAEEGFDVPDCK

SEQ ID NO: 6910 - protein, 40 aa, Artificial Sequence
  Description of Artificial Sequence: Synthetic polypeptide
LRENWLPEDKGKDKGEISEKAKLENSTQAEEGFDVPDCKK

SEQ ID NO: 6911 - protein, 40 aa, Artificial Sequence
  Description of Artificial Sequence: Synthetic polypeptide
RENWLPEDKGKDKGEISEKAKLENSTQAEEGFDVPDCKKT

SEQ ID NO: 6912 - protein, 40 aa, Artificial Sequence
  Description of Artificial Sequence: Synthetic polypeptide
ENWLPEDKGKDKGEISEKAKLENSTQAEEGFDVPDCKKTI

SEQ ID NO: 6913 - protein, 40 aa, Artificial Sequence
  Description of Artificial Sequence: Synthetic polypeptide
NWLPEDKGKDKGEISEKAKLENSTQAEEGFDVPDCKKTIV

SEQ ID NO: 6914 - protein, 40 aa, Artificial Sequence
  Description of Artificial Sequence: Synthetic polypeptide
EDKGKDKGEISEKAKLENSTQAEEGFDVPDCKKTIVNDSR

SEQ ID NO: 6915 - protein, 40 aa, Artificial Sequence
  Description of Artificial Sequence: Synthetic polypeptide
DKGKDKGEISEKAKLENSTQAEEGFDVPDCKKTIVNDSRE

SEQ ID NO: 6916 - protein, 40 aa, Artificial Sequence
  Description of Artificial Sequence: Synthetic polypeptide
KDKGEISEKAKLENSTQAEEGFDVPDCKKTIVNDSRESCV

SEQ ID NO: 6917 - protein, 40 aa, Artificial Sequence
  Description of Artificial Sequence: Synthetic polypeptide
DKGEISEKAKLENSTQAEEGFDVPDCKKTIVNDSRESCVE

SEQ ID NO: 6918 - protein, 40 aa, Artificial Sequence
  Description of Artificial Sequence: Synthetic polypeptide
EKAKLENSTQAEEGFDVPDCKKTIVNDSRESCVEENDDKI

SEQ ID NO: 6919 - protein, 40 aa, Artificial Sequence
  Description of Artificial Sequence: Synthetic polypeptide
AKLENSTQAEEGFDVPDCKKTIVNDSRESCVEENDDKITQ

SEQ ID NO: 6920 - protein, 40 aa, Artificial Sequence
  Description of Artificial Sequence: Synthetic polypeptide
MENSTQAEEGFDVPDCKKTIVNDSRESCVEENDDKITQAS

SEQ ID NO: 6921 - protein, 40 aa, Artificial Sequence
  Description of Artificial Sequence: Synthetic polypeptide
NSTQAEEGFDVPDCKKTIVNDSRESCVEENDDKITQASQS

SEQ ID NO: 6922 - protein, 40 aa, Artificial Sequence
  Description of Artificial Sequence: Synthetic polypeptide
STQAEEGFDVPDCKKTIVNDSRESCVEENDDKITQASQSQ

SEQ ID NO: 6923 - protein, 40 aa, Artificial Sequence
  Description of Artificial Sequence: Synthetic polypeptide
QAEEGFDVPDCKKTIVNDSRESCVEENDDKITQASQSQES

SEQ ID NO: 6924 - protein, 40 aa, Artificial Sequence
  Description of Artificial Sequence: Synthetic polypeptide
AEEGFDVPDCKKTIVNDSRESCVEENDDKITQASQSQESE

SEQ ID NO: 6925 - protein, 40 aa, Artificial Sequence
  Description of Artificial Sequence: Synthetic polypeptide
GFDVPDCKKTIVNDSRESCVEENDDKITQASQSQESEDYS

SEQ ID NO: 6926 - protein, 40 aa, Artificial Sequence
  Description of Artificial Sequence: Synthetic polypeptide
FDVPDCKKTIVNDSRESCVEENDDKITQASQSQESEDYSQ

SEQ ID NO: 6927 - protein, 40 aa, Artificial Sequence
  Description of Artificial Sequence: Synthetic polypeptide
DVPDCKKTIVNDSRESCVEENDDKITQASQSQESEDYSQP

SEQ ID NO: 6928 - protein, 40 aa, Artificial Sequence
  Description of Artificial Sequence: Synthetic polypeptide
VPDCKKTIVNDSRESCVEENDDKITQASQSQESEDYSQPS

SEQ ID NO: 6929 - protein, 40 aa, Artificial Sequence
  Description of Artificial Sequence: Synthetic polypeptide
ENDDKITQASQSQESEDYSQPSTSSSIIYSSQEDVKEFER

SEQ ID NO: 6930 - protein, 40 aa, Artificial Sequence
  Description of Artificial Sequence: Synthetic polypeptide
TQASQSQESEDYSQPSTSSSIIYSSQEDVKEFEREETQDK

SEQ ID NO: 6931 - protein, 40 aa, Artificial Sequence
  Description of Artificial Sequence: Synthetic polypeptide
ESEDYSQPSTSSSIIYSSQEDVKEFEREETQDKEESVESS

SEQ ID NO: 6932 - protein, 40 aa, Artificial Sequence
  Description of Artificial Sequence: Synthetic polypeptide
SQPSTSSSIIYSSQEDVKEFEREETQDKEESVESSLPLNA

SEQ ID NO: 6933 - protein, 40 aa, Artificial Sequence
  Description of Artificial Sequence: Synthetic polypeptide
PSTSSSIIYSSQEDVKEFEREETQDKEESVESSLPLNAIE

SEQ ID NO: 6934 - protein, 40 aa, Artificial Sequence
  Description of Artificial Sequence: Synthetic polypeptide
STSSSIIYSSQEDVKEFEREETQDKEESVESSLPLNAIEP

SEQ ID NO: 6935 - protein, 40 aa, Artificial Sequence
  Description of Artificial Sequence: Synthetic polypeptide
PLNAIEPCVICQGRPKNGCIVHGKTGHLMACFTCAKKLKK

SEQ ID NO: 6936 - protein, 40 aa, Artificial Sequence
  Description of Artificial Sequence: Synthetic polypeptide
VICQGRPKNGCIVHGKTGHLMACFTCAKKLKKRNKPCPVC

SEQ ID NO: 6937 - protein, 40 aa, Artificial Sequence
  Description of Artificial Sequence: Synthetic polypeptide
CQGRPKNGCIVHGKTGHLMACFTCAKKLKKRNKPCPVCRQ

SEQ ID NO: 6938 - protein, 40 aa, Artificial Sequence
  Description of Artificial Sequence: Synthetic polypeptide
RPKNGCIVHGKTGHLMACFTCAKKLKKRNKPCPVCRQPIQ

SEQ ID NO: 6939 - protein, 40 aa, Artificial Sequence
  Description of Artificial Sequence: Synthetic polypeptide
PKNGCIVHGKTGHLMACFTCAKKLKKRNKPCPVCRQPIQM

SEQ ID NO: 6940 - protein, 40 aa, Artificial Sequence
  Description of Artificial Sequence: Synthetic polypeptide
MTSFSTSAQCSTSDSACRISPGQINQVRPKLPLLKILHAA

SEQ ID NO: 6941 - protein, 40 aa, Artificial Sequence
  Description of Artificial Sequence: Synthetic polypeptide
SFSTSAQCSTSDSACRISPGQINQVRPKLPLLKILHAAGA

SEQ ID NO: 6942 - protein, 40 aa, Artificial Sequence
  Description of Artificial Sequence: Synthetic polypeptide
AQCSTSDSACRISPGQINQVRPKLPLLKILHAAGAQGEMF

SEQ ID NO: 6943 - protein, 40 aa, Artificial Sequence
  Description of Artificial Sequence: Synthetic polypeptide
CSTSDSACRISPGQINQVRPKLPLLKILHAAGAQGEMFTV

SEQ ID NO: 6944 - protein, 40 aa, Artificial Sequence
  Description of Artificial Sequence: Synthetic polypeptide
SDSACRISPGQINQVRPKLPLLKILHAAGAQGEMFTVKEV

SEQ ID NO: 6945 - protein, 40 aa, Artificial Sequence
  Description of Artificial Sequence: Synthetic polypeptide
DSACRISPGQINQVRPKLPLLKILHAAGAQGEMFTVKEVM

SEQ ID NO: 6946 - protein, 40 aa, Artificial Sequence
  Description of Artificial Sequence: Synthetic polypeptide
SACRISPGQINQVRPKLPLLKILHAAGAQGEMFTVKEVMH

SEQ ID NO: 6947 - protein, 40 aa, Artificial Sequence
  Description of Artificial Sequence: Synthetic polypeptide
ACRISPGQINQVRPKLPLLKILHAAGAQGEMFTVKEVMHY

SEQ ID NO: 6948 - protein, 40 aa, Artificial Sequence
  Description of Artificial Sequence: Synthetic polypeptide
ISPGQINQVRPKLPLLKILHAAGAQGEMFTVKEVMHYLGQ

SEQ ID NO: 6949 - protein, 40 aa, Artificial Sequence
  Description of Artificial Sequence: Synthetic polypeptide
SPGQINQVRPKLPLLKILHAAGAQGEMFTVKEVMHYLGQY

SEQ ID NO: 6950 - protein, 40 aa, Artificial Sequence
  Description of Artificial Sequence: Synthetic polypeptide
PGQINQVRPKLPLLKILHAAGAQGEMFTVKEVMHYLGQYI

SEQ ID NO: 6951 - protein, 40 aa, Artificial Sequence
  Description of Artificial Sequence: Synthetic polypeptide
GQINQVRPKLPLLKILHAAGAQGEMFTVKEVMHYLGQYIM

SEQ ID NO: 6952 - protein, 40 aa, Artificial Sequence
  Description of Artificial Sequence: Synthetic polypeptide
INQVRPKLPLLKILHAAGAQGEMFTVKEVMHYLGQYIMVK

SEQ ID NO: 6953 - protein, 40 aa, Artificial Sequence
  Description of Artificial Sequence: Synthetic polypeptide
NQVRPKLPLLKILHAAGAQGEMFTVKEVMHYLGQYIMVKQ

SEQ ID NO: 6954 - protein, 40 aa, Artificial Sequence
  Description of Artificial Sequence: Synthetic polypeptide
QVRPKLPLLKILHAAGAQGEMFTVKEVMHYLGQYIMVKQL

SEQ ID NO: 6955 - protein, 40 aa, Artificial Sequence
  Description of Artificial Sequence: Synthetic polypeptide
VRPKLPLLKILHAAGAQGEMFTVKEVMHYLGQYIMVKQLY

SEQ ID NO: 6956 - protein, 40 aa, Artificial Sequence
  Description of Artificial Sequence: Synthetic polypeptide
RPKLPLLKILHAAGAQGEMFTVKEVMHYLGQYIMVKQLYD

SEQ ID NO: 6957 - protein, 40 aa, Artificial Sequence
  Description of Artificial Sequence: Synthetic polypeptide
PKLPLLKILHAAGAQGEMFTVKEVMHYLGQYIMVKQLYDQ

SEQ ID NO: 6958 - protein, 40 aa, Artificial Sequence
  Description of Artificial Sequence: Synthetic polypeptide
KLPLLKILHAAGAQGEMFTVKEVMHYLGQYIMVKQLYDQQ

SEQ ID NO: 6959 - protein, 40 aa, Artificial Sequence
  Description of Artificial Sequence: Synthetic polypeptide
PLLKILHAAGAQGEMFTVKEVMHYLGQYIMVKQLYDQQEQ

SEQ ID NO: 6960 - protein, 40 aa, Artificial Sequence
  Description of Artificial Sequence: Synthetic polypeptide
MKILHAAGAQGEMFTVKEVMHYLGQYIMVKQLYDQQEQHM

SEQ ID NO: 6961 - protein, 40 aa, Artificial Sequence
  Description of Artificial Sequence: Synthetic polypeptide
KILHAAGAQGEMFTVKEVMHYLGQYIMVKQLYDQQEQHMV

SEQ ID NO: 6962 - protein, 40 aa, Artificial Sequence
  Description of Artificial Sequence: Synthetic polypeptide
ILHAAGAQGEMFTVKEVMHYLGQYIMVKQLYDQQEQHMVY

SEQ ID NO: 6963 - protein, 40 aa, Artificial Sequence
  Description of Artificial Sequence: Synthetic polypeptide
MHAAGAQGEMFTVKEVMHYLGQYIMVKQLYDQQEQHMVYC

SEQ ID NO: 6964 - protein, 40 aa, Artificial Sequence
  Description of Artificial Sequence: Synthetic polypeptide
AGAQGEMFTVKEVMHYLGQYIMVKQLYDQQEQHMVYCGGD

SEQ ID NO: 6965 - protein, 40 aa, Artificial Sequence
  Description of Artificial Sequence: Synthetic polypeptide
AQGEMFTVKEVMHYLGQYIMVKQLYDQQEQHMVYCGGDLL

SEQ ID NO: 6966 - protein, 40 aa, Artificial Sequence
  Description of Artificial Sequence: Synthetic polypeptide
GEMFTVKEVMHYLGQYIMVKQLYDQQEQHMVYCGGDLLGE

SEQ ID NO: 6967 - protein, 40 aa, Artificial Sequence
  Description of Artificial Sequence: Synthetic polypeptide
EMFTVKEVMHYLGQYIMVKQLYDQQEQHMVYCGGDLLGEL

SEQ ID NO: 6968 - protein, 40 aa, Artificial Sequence
  Description of Artificial Sequence: Synthetic polypeptide
FTVKEVMHYLGQYIMVKQLYDQQEQHMVYCGGDLLGELLG

SEQ ID NO: 6969 - protein, 40 aa, Artificial Sequence
  Description of Artificial Sequence: Synthetic polypeptide
VKEVMHYLGQYIMVKQLYDQQEQHMVYCGGDLLGELLGRQ

SEQ ID NO: 6970 - protein, 40 aa, Artificial Sequence
  Description of Artificial Sequence: Synthetic polypeptide
VMHYLGQYIMVKQLYDQQEQHMVYCGGDLLGELLGRQSFS

SEQ ID NO: 6971 - protein, 40 aa, Artificial Sequence
  Description of Artificial Sequence: Synthetic polypeptide
MVKQLYDQQEQHMVYCGGDLLGELLGRQSFSVKDPSPLYD

SEQ ID NO: 6972 - protein, 40 aa, Artificial Sequence
  Description of Artificial Sequence: Synthetic polypeptide
DQQEQHMVYCGGDLLGELLGRQSFSVKDPSPLYDMLRKNL

SEQ ID NO: 6973 - protein, 40 aa, Artificial Sequence
  Description of Artificial Sequence: Synthetic polypeptide
QQEQHMVYCGGDLLGELLGRQSFSVKDPSPLYDMLRKNLV

SEQ ID NO: 6974 - protein, 40 aa, Artificial Sequence
  Description of Artificial Sequence: Synthetic polypeptide
EQHMVYCGGDLLGELLGRQSFSVKDPSPLYDMLRKNLVTL

SEQ ID NO: 6975 - protein, 40 aa, Artificial Sequence
  Description of Artificial Sequence: Synthetic polypeptide
HMVYCGGDLLGELLGRQSFSVKDPSPLYDMLRKNLVTLAT

SEQ ID NO: 6976 - protein, 40 aa, Artificial Sequence
  Description of Artificial Sequence: Synthetic polypeptide
VYCGGDLLGELLGRQSFSVKDPSPLYDMLRKNLVTLATAT

SEQ ID NO: 6977 - protein, 40 aa, Artificial Sequence
  Description of Artificial Sequence: Synthetic polypeptide
PSPLYDMLRKNLVTLATATTDAAQTLALAQDHSMDIPSQD

SEQ ID NO: 6978 - protein, 40 aa, Artificial Sequence
  Description of Artificial Sequence: Synthetic polypeptide
LAQDHSMDIPSQDQLKQSAEESSTSRKRTTEDDIPTLPTS

SEQ ID NO: 6979 - protein, 40 aa, Artificial Sequence
  Description of Artificial Sequence: Synthetic polypeptide
DHSMDIPSQDQLKQSAEESSTSRKRTTEDDIPTLPTSEHK

SEQ ID NO: 6980 - protein, 40 aa, Artificial Sequence
  Description of Artificial Sequence: Synthetic polypeptide
SQDQLKQSAEESSTSRKRTTEDDIPTLPTSEHKCIHSRED

SEQ ID NO: 6981 - protein, 40 aa, Artificial Sequence
  Description of Artificial Sequence: Synthetic polypeptide
QLKQSAEESSTSRKRTTEDDIPTLPTSEHKCIHSREDEDL

SEQ ID NO: 6982 - protein, 40 aa, Artificial Sequence
  Description of Artificial Sequence: Synthetic polypeptide
KQSAEESSTSRKRTTEDDIPTLPTSEHKCIHSREDEDLIE

SEQ ID NO: 6983 - protein, 40 aa, Artificial Sequence
  Description of Artificial Sequence: Synthetic polypeptide
AEESSTSRKRTTEDDIPTLPTSEHKCIHSREDEDLIENLA

SEQ ID NO: 6984 - protein, 40 aa, Artificial Sequence
  Description of Artificial Sequence: Synthetic polypeptide
STSRKRTTEDDIPTLPTSEHKCIHSREDEDLIENLAQDET

SEQ ID NO: 6985 - protein, 40 aa, Artificial Sequence
  Description of Artificial Sequence: Synthetic polypeptide
TSRKRTTEDDIPTLPTSEHKCIHSREDEDLIENLAQDETS

SEQ ID NO: 6986 - protein, 40 aa, Artificial Sequence
  Description of Artificial Sequence: Synthetic polypeptide
RKRTTEDDIPTLPTSEHKCIHSREDEDLIENLAQDETSRL

SEQ ID NO: 6987 - protein, 40 aa, Artificial Sequence
  Description of Artificial Sequence: Synthetic polypeptide
DLGFEEWDVAGLPWWFLGNLRSNYTPRSNGSTDLQTNQDV

SEQ ID NO: 6988 - protein, 40 aa, Artificial Sequence
  Description of Artificial Sequence: Synthetic polypeptide
LGFEEWDVAGLPWWFLGNLRSNYTPRSNGSTDLQTNQDVG

SEQ ID NO: 6989 - protein, 40 aa, Artificial Sequence
  Description of Artificial Sequence: Synthetic polypeptide
GFEEWDVAGLPWWFLGNLRSNYTPRSNGSTDLQTNQDVGT

SEQ ID NO: 6990 - protein, 40 aa, Artificial Sequence
  Description of Artificial Sequence: Synthetic polypeptide
NYTPRSNGSTDLQTNQDVGTAIVSDTTDDLWFLNESVSEQ

SEQ ID NO: 6991 - protein, 40 aa, Artificial Sequence
  Description of Artificial Sequence: Synthetic polypeptide
YTPRSNGSTDLQTNQDVGTAIVSDTTDDLWFLNESVSEQL

SEQ ID NO: 6992 - protein, 40 aa, Artificial Sequence
  Description of Artificial Sequence: Synthetic polypeptide
GSTDLQTNQDVGTAIVSDTTDDLWFLNESVSEQLGVGIKV

SEQ ID NO: 6993 - protein, 40 aa, Artificial Sequence
  Description of Artificial Sequence: Synthetic polypeptide
QTNQDVGTAIVSDTTDDLWFLNESVSEQLGVGIKVEAADT

SEQ ID NO: 6994 - protein, 40 aa, Artificial Sequence
  Description of Artificial Sequence: Synthetic polypeptide
TNQDVGTAIVSDTTDDLWFLNESVSEQLGVGIKVEAADTE

SEQ ID NO: 6995 - protein, 40 aa, Artificial Sequence
  Description of Artificial Sequence: Synthetic polypeptide
NQDVGTAIVSDTTDDLWFLNESVSEQLGVGIKVEAADTEQ

SEQ ID NO: 6996 - protein, 40 aa, Artificial Sequence
  Description of Artificial Sequence: Synthetic polypeptide
AIVSDTTDDLWFLNESVSEQLGVGIKVEAADTEQTSEEVG

SEQ ID NO: 6997 - protein, 40 aa, Artificial Sequence
  Description of Artificial Sequence: Synthetic polypeptide
DTTDDLWFLNESVSEQLGVGIKVEAADTEQTSEEVGKVSD

SEQ ID NO: 6998 - protein, 40 aa, Artificial Sequence
  Description of Artificial Sequence: Synthetic polypeptide
TTDDLWFLNESVSEQLGVGIKVEAADTEQTSEEVGKVSDK

SEQ ID NO: 6999 - protein, 40 aa, Artificial Sequence
  Description of Artificial Sequence: Synthetic polypeptide
DLWFLNESVSEQLGVGIKVEAADTEQTSEEVGKVSDKKVI

SEQ ID NO: 7000 - protein, 40 aa, Artificial Sequence
  Description of Artificial Sequence: Synthetic polypeptide
NESVSEQLGVGIKVEAADTEQTSEEVGKVSDKKVIEVGKN

SEQ ID NO: 7001 - protein, 40 aa, Artificial Sequence
  Description of Artificial Sequence: Synthetic polypeptide
SVSEQLGVGIKVEAADTEQTSEEVGKVSDKKVIEVGKNDD

SEQ ID NO: 7002 - protein, 40 aa, Artificial Sequence
  Description of Artificial Sequence: Synthetic polypeptide
VEAADTEQTSEEVGKVSDKKVIEVGKNDDLEDSKSLSDDT

SEQ ID NO: 7003 - protein, 40 aa, Artificial Sequence
  Description of Artificial Sequence: Synthetic polypeptide
EAADTEQTSEEVGKVSDKKVIEVGKNDDLEDSKSLSDDTD

SEQ ID NO: 7004 - protein, 40 aa, Artificial Sequence
  Description of Artificial Sequence: Synthetic polypeptide
AADTEQTSEEVGKVSDKKVIEVGKNDDLEDSKSLSDDTDV

SEQ ID NO: 7005 - protein, 40 aa, Artificial Sequence
  Description of Artificial Sequence: Synthetic polypeptide
TEQTSEEVGKVSDKKVIEVGKNDDLEDSKSLSDDTDVEVT

SEQ ID NO: 7006 - protein, 40 aa, Artificial Sequence
  Description of Artificial Sequence: Synthetic polypeptide
QTSEEVGKVSDKKVIEVGKNDDLEDSKSLSDDTDVEVTSE

SEQ ID NO: 7007 - protein, 40 aa, Artificial Sequence
  Description of Artificial Sequence: Synthetic polypeptide
TSEEVGKVSDKKVIEVGKNDDLEDSKSLSDDTDVEVTSED

SEQ ID NO: 7008 - protein, 40 aa, Artificial Sequence
  Description of Artificial Sequence: Synthetic polypeptide
EVGKVSDKKVIEVGKNDDLEDSKSLSDDTDVEVTSEDEWQ

SEQ ID NO: 7009 - protein, 40 aa, Artificial Sequence
  Description of Artificial Sequence: Synthetic polypeptide
GKVSDKKVIEVGKNDDLEDSKSLSDDTDVEVTSEDEWQCT

SEQ ID NO: 7010 - protein, 40 aa, Artificial Sequence
  Description of Artificial Sequence: Synthetic polypeptide
KVSDKKVIEVGKNDDLEDSKSLSDDTDVEVTSEDEWQCTE

SEQ ID NO: 7011 - protein, 40 aa, Artificial Sequence
  Description of Artificial Sequence: Synthetic polypeptide
DKKVIEVGKNDDLEDSKSLSDDTDVEVTSEDEWQCTECKK

SEQ ID NO: 7012 - protein, 40 aa, Artificial Sequence
  Description of Artificial Sequence: Synthetic polypeptide
EVGKNDDLEDSKSLSDDTDVEVTSEDEWQCTECKKFNSPS

SEQ ID NO: 7013 - protein, 40 aa, Artificial Sequence
  Description of Artificial Sequence: Synthetic polypeptide
KNDDLEDSKSLSDDTDVEVTSEDEWQCTECKKFNSPSKRY

SEQ ID NO: 7014 - protein, 40 aa, Artificial Sequence
  Description of Artificial Sequence: Synthetic polypeptide
SKSLSDDTDVEVTSEDEWQCTECKKFNSPSKRYCFRCWAL

SEQ ID NO: 7015 - protein, 40 aa, Artificial Sequence
  Description of Artificial Sequence: Synthetic polypeptide
DTDVEVTSEDEWQCTECKKFNSPSKRYCFRCWALRKDWYS

SEQ ID NO: 7016 - protein, 40 aa, Artificial Sequence
  Description of Artificial Sequence: Synthetic polypeptide
DVEVTSEDEWQCTECKKFNSPSKRYCFRCWALRKDWYSDC

SEQ ID NO: 7017 - protein, 40 aa, Artificial Sequence
  Description of Artificial Sequence: Synthetic polypeptide
EVTSEDEWQCTECKKFNSPSKRYCFRCWALRKDWYSDCSK

SEQ ID NO: 7018 - protein, 40 aa, Artificial Sequence
  Description of Artificial Sequence: Synthetic polypeptide
TSEDEWQCTECKKFNSPSKRYCFRCWALRKDWYSDCSKLT

SEQ ID NO: 7019 - protein, 40 aa, Artificial Sequence
  Description of Artificial Sequence: Synthetic polypeptide
SEDEWQCTECKKFNSPSKRYCFRCWALRKDWYSDCSKLTH

SEQ ID NO: 7020 - protein, 40 aa, Artificial Sequence
  Description of Artificial Sequence: Synthetic polypeptide
WQCTECKKFNSPSKRYCFRCWALRKDWYSDCSKLTHSLST

SEQ ID NO: 7021 - protein, 40 aa, Artificial Sequence
  Description of Artificial Sequence: Synthetic polypeptide
CTECKKFNSPSKRYCFRCWALRKDWYSDCSKLTHSLSTSD

SEQ ID NO: 7022 - protein, 40 aa, Artificial Sequence
  Description of Artificial Sequence: Synthetic polypeptide
TECKKFNSPSKRYCFRCWALRKDWYSDCSKLTHSLSTSDI

SEQ ID NO: 7023 - protein, 40 aa, Artificial Sequence
  Description of Artificial Sequence: Synthetic polypeptide
CKKFNSPSKRYCFRCWALRKDWYSDCSKLTHSLSTSDITA

SEQ ID NO: 7024 - protein, 40 aa, Artificial Sequence
  Description of Artificial Sequence: Synthetic polypeptide
KKFNSPSKRYCFRCWALRKDWYSDCSKLTHSLSTSDITAI

SEQ ID NO: 7025 - protein, 40 aa, Artificial Sequence
  Description of Artificial Sequence: Synthetic polypeptide
KFNSPSKRYCFRCWALRKDWYSDCSKLTHSLSTSDITAIP

SEQ ID NO: 7026 - protein, 40 aa, Artificial Sequence
  Description of Artificial Sequence: Synthetic polypeptide
NSPSKRYCFRCWALRKDWYSDCSKLTHSLSTSDITAIPEK

SEQ ID NO: 7027 - protein, 40 aa, Artificial Sequence
  Description of Artificial Sequence: Synthetic polypeptide
SPSKRYCFRCWALRKDWYSDCSKLTHSLSTSDITAIPEKE

SEQ ID NO: 7028 - protein, 40 aa, Artificial Sequence
  Description of Artificial Sequence: Synthetic polypeptide
PSKRYCFRCWALRKDWYSDCSKLTHSLSTSDITAIPEKEN

SEQ ID NO: 7029 - protein, 40 aa, Artificial Sequence
  Description of Artificial Sequence: Synthetic polypeptide
RYCFRCWALRKDWYSDCSKLTHSLSTSDITAIPEKENEGN

SEQ ID NO: 7030 - protein, 40 aa, Artificial Sequence
  Description of Artificial Sequence: Synthetic polypeptide
TSDITAIPEKENEGNDVPDCRRTISAPVVRPKDAYIKKEN

SEQ ID NO: 7031 - protein, 40 aa, Artificial Sequence
  Description of Artificial Sequence: Synthetic polypeptide
SDITAIPEKENEGNDVPDCRRTISAPVVRPKDAYIKKENS

SEQ ID NO: 7032 - protein, 40 aa, Artificial Sequence
  Description of Artificial Sequence: Synthetic polypeptide
DITAIPEKENEGNDVPDCRRTISAPVVRPKDAYIKKENSK

SEQ ID NO: 7033 - protein, 40 aa, Artificial Sequence
  Description of Artificial Sequence: Synthetic polypeptide
ITAIPEKENEGNDVPDCRRTISAPVVRPKDAYIKKENSKL

SEQ ID NO: 7034 - protein, 40 aa, Artificial Sequence
  Description of Artificial Sequence: Synthetic polypeptide
PDCRRTISAPVVRPKDAYIKKENSKLFDPCNSVEFLDLAH

SEQ ID NO: 7035 - protein, 40 aa, Artificial Sequence
  Description of Artificial Sequence: Synthetic polypeptide
DCRRTISAPVVRPKDAYIKKENSKLFDPCNSVEFLDLAHS

SEQ ID NO: 7036 - protein, 40 aa, Artificial Sequence
  Description of Artificial Sequence: Synthetic polypeptide
CRRTISAPVVRPKDAYIKKENSKLFDPCNSVEFLDLAHSS

SEQ ID NO: 7037 - protein, 40 aa, Artificial Sequence
  Description of Artificial Sequence: Synthetic polypeptide
RTISAPVVRPKDAYIKKENSKLFDPCNSVEFLDLAHSSES

SEQ ID NO: 7038 - protein, 40 aa, Artificial Sequence
  Description of Artificial Sequence: Synthetic polypeptide
VRPKDAYIKKENSKLFDPCNSVEFLDLAHSSESQETISSM

SEQ ID NO: 7039 - protein, 40 aa, Artificial Sequence
  Description of Artificial Sequence: Synthetic polypeptide
RPKDAYIKKENSKLFDPCNSVEFLDLAHSSESQETISSMG

SEQ ID NO: 7040 - protein, 40 aa, Artificial Sequence
  Description of Artificial Sequence: Synthetic polypeptide
AYIKKENSKLFDPCNSVEFLDLAHSSESQETISSMGEQLD

SEQ ID NO: 7041 - protein, 40 aa, Artificial Sequence
  Description of Artificial Sequence: Synthetic polypeptide
IKKENSKLFDPCNSVEFLDLAHSSESQETISSMGEQLDNL

SEQ ID NO: 7042 - protein, 40 aa, Artificial Sequence
  Description of Artificial Sequence: Synthetic polypeptide
KKENSKLFDPCNSVEFLDLAHSSESQETISSMGEQLDNLS

SEQ ID NO: 7043 - protein, 40 aa, Artificial Sequence
  Description of Artificial Sequence: Synthetic polypeptide
QETISSMGEQLDNLSEQRTDTENMEDCQNLLKPCSLCEKR

SEQ ID NO: 7044 - protein, 40 aa, Artificial Sequence
  Description of Artificial Sequence: Synthetic polypeptide
NLLKPCSLCEKRPRDGNIIHGRTGHLVTCFHCARRLKKAG

SEQ ID NO: 7045 - protein, 40 aa, Artificial Sequence
  Description of Artificial Sequence: Synthetic polypeptide
KRPRDGNIIHGRTGHLVTCFHCARRLKKAGASCPICKKEI

SEQ ID NO: 7046 - protein, 40 aa, Artificial Sequence
  Description of Artificial Sequence: Synthetic polypeptide
RPRDGNIIHGRTGHLVTCFHCARRLKKAGASCPICKKEIQ

SEQ ID NO: 7047 - protein, 40 aa, Artificial Sequence
  Description of Artificial Sequence: Synthetic polypeptide
PRDGNIIHGRTGHLVTCFHCARRLKKAGASCPICKKEIQL

SEQ ID NO: 7048 - protein, 40 aa, Artificial Sequence
  Description of Artificial Sequence: Synthetic polypeptide
DGNIIHGRTGHLVTCFHCARRLKKAGASCPICKKEIQLVI

SEQ ID NO: 7049 - protein, 40 aa, Artificial Sequence
  Description of Artificial Sequence: Synthetic polypeptide
GNIIHGRTGHLVTCFHCARRLKKAGASCPICKKEIQLVIK

SEQ ID NO: 7050 - protein, 40 aa, Artificial Sequence
  Description of Artificial Sequence: Synthetic polypeptide
NIIHGRTGHLVTCFHCARRLKKAGASCPICKKEIQLVIKV

SEQ ID NO: 7051 - protein, 40 aa, Artificial Sequence
  Description of Artificial Sequence: Synthetic polypeptide
IIHGRTGHLVTCFHCARRLKKAGASCPICKKEIQLVIKVF

SEQ ID NO: 7052 - protein, 40 aa, Artificial Sequence
  Description of Artificial Sequence: Synthetic polypeptide
IHGRTGHLVTCFHCARRLKKAGASCPICKKEIQLVIKVFI

SEQ ID NO: 7053 - protein, 40 aa, Artificial Sequence
  Description of Artificial Sequence: Synthetic polypeptide
MKAPAVLAPGILVLLFTLVQRSNGECKEALAKSEMNVNMK

SEQ ID NO: 7054 - protein, 40 aa, Artificial Sequence
  Description of Artificial Sequence: Synthetic polypeptide
SEMNVNMKYQLPNFTAETPIQNVILHEHHIFLGATNYIYV

SEQ ID NO: 7055 - protein, 40 aa, Artificial Sequence
  Description of Artificial Sequence: Synthetic polypeptide
QRHVFPHNHTADIQSEVHCIFSPQIEEPSQCPDCVVSALG

SEQ ID NO: 7056 - protein, 40 aa, Artificial Sequence
  Description of Artificial Sequence: Synthetic polypeptide
VFPHNHTADIQSEVHCIFSPQIEEPSQCPDCVVSALGAKV

SEQ ID NO: 7057 - protein, 40 aa, Artificial Sequence
  Description of Artificial Sequence: Synthetic polypeptide
EVHCIFSPQIEEPSQCPDCVVSALGAKVLSSVKDRFINFF

SEQ ID NO: 7058 - protein, 40 aa, Artificial Sequence
  Description of Artificial Sequence: Synthetic polypeptide
VHCIFSPQIEEPSQCPDCVVSALGAKVLSSVKDRFINFFV

SEQ ID NO: 7059 - protein, 40 aa, Artificial Sequence
  Description of Artificial Sequence: Synthetic polypeptide
CIFSPQIEEPSQCPDCVVSALGAKVLSSVKDRFINFFVGN

SEQ ID NO: 7060 - protein, 40 aa, Artificial Sequence
  Description of Artificial Sequence: Synthetic polypeptide
IFSPQIEEPSQCPDCVVSALGAKVLSSVKDRFINFFVGNT

SEQ ID NO: 7061 - protein, 40 aa, Artificial Sequence
  Description of Artificial Sequence: Synthetic polypeptide
FSPQIEEPSQCPDCVVSALGAKVLSSVKDRFINFFVGNTI

SEQ ID NO: 7062 - protein, 40 aa, Artificial Sequence
  Description of Artificial Sequence: Synthetic polypeptide
SPQIEEPSQCPDCVVSALGAKVLSSVKDRFINFFVGNTIN

SEQ ID NO: 7063 - protein, 40 aa, Artificial Sequence
  Description of Artificial Sequence: Synthetic polypeptide
PQIEEPSQCPDCVVSALGAKVLSSVKDRFINFFVGNTINS

SEQ ID NO: 7064 - protein, 40 aa, Artificial Sequence
  Description of Artificial Sequence: Synthetic polypeptide
IEEPSQCPDCVVSALGAKVLSSVKDRFINFFVGNTINSSY

SEQ ID NO: 7065 - protein, 40 aa, Artificial Sequence
  Description of Artificial Sequence: Synthetic polypeptide
EPSQCPDCVVSALGAKVLSSVKDRFINFFVGNTINSSYFP

SEQ ID NO: 7066 - protein, 40 aa, Artificial Sequence
  Description of Artificial Sequence: Synthetic polypeptide
PSQCPDCVVSALGAKVLSSVKDRFINFFVGNTINSSYFPD

SEQ ID NO: 7067 - protein, 40 aa, Artificial Sequence
  Description of Artificial Sequence: Synthetic polypeptide
SQCPDCVVSALGAKVLSSVKDRFINFFVGNTINSSYFPDH

SEQ ID NO: 7068 - protein, 40 aa, Artificial Sequence
  Description of Artificial Sequence: Synthetic polypeptide
QCPDCVVSALGAKVLSSVKDRFINFFVGNTINSSYFPDHP

SEQ ID NO: 7069 - protein, 40 aa, Artificial Sequence
  Description of Artificial Sequence: Synthetic polypeptide
PDCVVSALGAKVLSSVKDRFINFFVGNTINSSYFPDHPLH

SEQ ID NO: 7070 - protein, 40 aa, Artificial Sequence
  Description of Artificial Sequence: Synthetic polypeptide
DCVVSALGAKVLSSVKDRFINFFVGNTINSSYFPDHPLHS

SEQ ID NO: 7071 - protein, 40 aa, Artificial Sequence
  Description of Artificial Sequence: Synthetic polypeptide
CVVSALGAKVLSSVKDRFINFFVGNTINSSYFPDHPLHSI

SEQ ID NO: 7072 - protein, 40 aa, Artificial Sequence
  Description of Artificial Sequence: Synthetic polypeptide
VSALGAKVLSSVKDRFINFFVGNTINSSYFPDHPLHSISV

SEQ ID NO: 7073 - protein, 40 aa, Artificial Sequence
  Description of Artificial Sequence: Synthetic polypeptide
SALGAKVLSSVKDRFINFFVGNTINSSYFPDHPLHSISVR

SEQ ID NO: 7074 - protein, 40 aa, Artificial Sequence
  Description of Artificial Sequence: Synthetic polypeptide
VLSSVKDRFINFFVGNTINSSYFPDHPLHSISVRRLKETK

SEQ ID NO: 7075 - protein, 40 aa, Artificial Sequence
  Description of Artificial Sequence: Synthetic polypeptide
FINFFVGNTINSSYFPDHPLHSISVRRLKETKDGFMFLTD

SEQ ID NO: 7076 - protein, 40 aa, Artificial Sequence
  Description of Artificial Sequence: Synthetic polypeptide
LKETKDGFMFLTDQSYIDVLPEFRDSYPIKYVHAFESNNF

SEQ ID NO: 7077 - protein, 40 aa, Artificial Sequence
  Description of Artificial Sequence: Synthetic polypeptide
KETKDGFMFLTDQSYIDVLPEFRDSYPIKYVHAFESNNFI

SEQ ID NO: 7078 - protein, 40 aa, Artificial Sequence
  Description of Artificial Sequence: Synthetic polypeptide
ETKDGFMFLTDQSYIDVLPEFRDSYPIKYVHAFESNNFIY

SEQ ID NO: 7079 - protein, 40 aa, Artificial Sequence
  Description of Artificial Sequence: Synthetic polypeptide
KDGFMFLTDQSYIDVLPEFRDSYPIKYVHAFESNNFIYFL

SEQ ID NO: 7080 - protein, 40 aa, Artificial Sequence
  Description of Artificial Sequence: Synthetic polypeptide
DGFMFLTDQSYIDVLPEFRDSYPIKYVHAFESNNFIYFLT

SEQ ID NO: 7081 - protein, 40 aa, Artificial Sequence
  Description of Artificial Sequence: Synthetic polypeptide
GFMFLTDQSYIDVLPEFRDSYPIKYVHAFESNNFIYFLTV

SEQ ID NO: 7082 - protein, 40 aa, Artificial Sequence
  Description of Artificial Sequence: Synthetic polypeptide
MFLTDQSYIDVLPEFRDSYPIKYVHAFESNNFIYFLTVQR

SEQ ID NO: 7083 - protein, 40 aa, Artificial Sequence
  Description of Artificial Sequence: Synthetic polypeptide
TDQSYIDVLPEFRDSYPIKYVHAFESNNFIYFLTVQRETL

SEQ ID NO: 7084 - protein, 40 aa, Artificial Sequence
  Description of Artificial Sequence: Synthetic polypeptide
DQSYIDVLPEFRDSYPIKYVHAFESNNFIYFLTVQRETLD

SEQ ID NO: 7085 - protein, 40 aa, Artificial Sequence
  Description of Artificial Sequence: Synthetic polypeptide
QSYIDVLPEFRDSYPIKYVHAFESNNFIYFLTVQRETLDA

SEQ ID NO: 7086 - protein, 40 aa, Artificial Sequence
  Description of Artificial Sequence: Synthetic polypeptide
SYIDVLPEFRDSYPIKYVHAFESNNFIYFLTVQRETLDAQ

SEQ ID NO: 7087 - protein, 40 aa, Artificial Sequence
  Description of Artificial Sequence: Synthetic polypeptide
IDVLPEFRDSYPIKYVHAFESNNFIYFLTVQRETLDAQTF

SEQ ID NO: 7088 - protein, 40 aa, Artificial Sequence
  Description of Artificial Sequence: Synthetic polypeptide
DVLPEFRDSYPIKYVHAFESNNFIYFLTVQRETLDAQTFH

SEQ ID NO: 7089 - protein, 40 aa, Artificial Sequence
  Description of Artificial Sequence: Synthetic polypeptide
LPEFRDSYPIKYVHAFESNNFIYFLTVQRETLDAQTFHTR

SEQ ID NO: 7090 - protein, 40 aa, Artificial Sequence
  Description of Artificial Sequence: Synthetic polypeptide
PEFRDSYPIKYVHAFESNNFIYFLTVQRETLDAQTFHTRI

SEQ ID NO: 7091 - protein, 40 aa, Artificial Sequence
  Description of Artificial Sequence: Synthetic polypeptide
EFRDSYPIKYVHAFESNNFIYFLTVQRETLDAQTFHTRII

SEQ ID NO: 7092 - protein, 40 aa, Artificial Sequence
  Description of Artificial Sequence: Synthetic polypeptide
DSYPIKYVHAFESNNFIYFLTVQRETLDAQTFHTRIIRFC

SEQ ID NO: 7093 - protein, 40 aa, Artificial Sequence
  Description of Artificial Sequence: Synthetic polypeptide
SYPIKYVHAFESNNFIYFLTVQRETLDAQTFHTRIIRFCS

SEQ ID NO: 7094 - protein, 40 aa, Artificial Sequence
  Description of Artificial Sequence: Synthetic polypeptide
YPIKYVHAFESNNFIYFLTVQRETLDAQTFHTRIIRFCSI

SEQ ID NO: 7095 - protein, 40 aa, Artificial Sequence
  Description of Artificial Sequence: Synthetic polypeptide
PIKYVHAFESNNFIYFLTVQRETLDAQTFHTRIIRFCSIN

SEQ ID NO: 7096 - protein, 40 aa, Artificial Sequence
  Description of Artificial Sequence: Synthetic polypeptide
KYVHAFESNNFIYFLTVQRETLDAQTFHTRIIRFCSINSG

SEQ ID NO: 7097 - protein, 40 aa, Artificial Sequence
  Description of Artificial Sequence: Synthetic polypeptide
YVHAFESNNFIYFLTVQRETLDAQTFHTRIIRFCSINSGL

SEQ ID NO: 7098 - protein, 40 aa, Artificial Sequence
  Description of Artificial Sequence: Synthetic polypeptide
VHAFESNNFIYFLTVQRETLDAQTFHTRIIRFCSINSGLH

SEQ ID NO: 7099 - protein, 40 aa, Artificial Sequence
  Description of Artificial Sequence: Synthetic polypeptide
HAFESNNFIYFLTVQRETLDAQTFHTRIIRFCSINSGLHS

SEQ ID NO: 7100 - protein, 40 aa, Artificial Sequence
  Description of Artificial Sequence: Synthetic polypeptide
FESNNFIYFLTVQRETLDAQTFHTRIIRFCSINSGLHSYM

SEQ ID NO: 7101 - protein, 40 aa, Artificial Sequence
  Description of Artificial Sequence: Synthetic polypeptide
NNFIYFLTVQRETLDAQTFHTRIIRFCSINSGLHSYMEMP

SEQ ID NO: 7102 - protein, 40 aa, Artificial Sequence
  Description of Artificial Sequence: Synthetic polypeptide
NFIYFLTVQRETLDAQTFHTRIIRFCSINSGLHSYMEMPL

SEQ ID NO: 7103 - protein, 40 aa, Artificial Sequence
  Description of Artificial Sequence: Synthetic polypeptide
FIYFLTVQRETLDAQTFHTRIIRFCSINSGLHSYMEMPLE

SEQ ID NO: 7104 - protein, 40 aa, Artificial Sequence
  Description of Artificial Sequence: Synthetic polypeptide
VQRETLDAQTFHTRIIRFCSINSGLHSYMEMPLECILTEK

SEQ ID NO: 7105 - protein, 40 aa, Artificial Sequence
  Description of Artificial Sequence: Synthetic polypeptide
RETLDAQTFHTRIIRFCSINSGLHSYMEMPLECILTEKRK

SEQ ID NO: 7106 - protein, 40 aa, Artificial Sequence
  Description of Artificial Sequence: Synthetic polypeptide
TLDAQTFHTRIIRFCSINSGLHSYMEMPLECILTEKRKKR

SEQ ID NO: 7107 - protein, 40 aa, Artificial Sequence
  Description of Artificial Sequence: Synthetic polypeptide
LDAQTFHTRIIRFCSINSGLHSYMEMPLECILTEKRKKRS

SEQ ID NO: 7108 - protein, 40 aa, Artificial Sequence
  Description of Artificial Sequence: Synthetic polypeptide
QTFHTRIIRFCSINSGLHSYMEMPLECILTEKRKKRSTKK

SEQ ID NO: 7109 - protein, 40 aa, Artificial Sequence
  Description of Artificial Sequence: Synthetic polypeptide
FHTRIIRFCSINSGLHSYMEMPLECILTEKRKKRSTKKEV

SEQ ID NO: 7110 - protein, 40 aa, Artificial Sequence
  Description of Artificial Sequence: Synthetic polypeptide
IIRFCSINSGLHSYMEMPLECILTEKRKKRSTKKEVFNIL

SEQ ID NO: 7111 - protein, 40 aa, Artificial Sequence
  Description of Artificial Sequence: Synthetic polypeptide
FCSINSGLHSYMEMPLECILTEKRKKRSTKKEVFNILQAA

SEQ ID NO: 7112 - protein, 40 aa, Artificial Sequence
  Description of Artificial Sequence: Synthetic polypeptide
INSGLHSYMEMPLECILTEKRKKRSTKKEVFNILQAAYVS

SEQ ID NO: 7113 - protein, 40 aa, Artificial Sequence
  Description of Artificial Sequence: Synthetic polypeptide
MHSYMEMPLECILTEKRKKRSTKKEVFNILQAAYVSKPGA

SEQ ID NO: 7114 - protein, 40 aa, Artificial Sequence
  Description of Artificial Sequence: Synthetic polypeptide
HSYMEMPLECILTEKRKKRSTKKEVFNILQAAYVSKPGAQ

SEQ ID NO: 7115 - protein, 40 aa, Artificial Sequence
  Description of Artificial Sequence: Synthetic polypeptide
SYMEMPLECILTEKRKKRSTKKEVFNILQAAYVSKPGAQL

SEQ ID NO: 7116 - protein, 40 aa, Artificial Sequence
  Description of Artificial Sequence: Synthetic polypeptide
YMEMPLECILTEKRKKRSTKKEVFNILQAAYVSKPGAQLA

SEQ ID NO: 7117 - protein, 40 aa, Artificial Sequence
  Description of Artificial Sequence: Synthetic polypeptide
MEMPLECILTEKRKKRSTKKEVFNILQAAYVSKPGAQLAR

SEQ ID NO: 7118 - protein, 40 aa, Artificial Sequence
  Description of Artificial Sequence: Synthetic polypeptide
EMPLECILTEKRKKRSTKKEVFNILQAAYVSKPGAQLARQ

SEQ ID NO: 7119 - protein, 40 aa, Artificial Sequence
  Description of Artificial Sequence: Synthetic polypeptide
MPLECILTEKRKKRSTKKEVFNILQAAYVSKPGAQLARQI

SEQ ID NO: 7120 - protein, 40 aa, Artificial Sequence
  Description of Artificial Sequence: Synthetic polypeptide
PLECILTEKRKKRSTKKEVFNILQAAYVSKPGAQLARQIG

SEQ ID NO: 7121 - protein, 40 aa, Artificial Sequence
  Description of Artificial Sequence: Synthetic polypeptide
ECILTEKRKKRSTKKEVFNILQAAYVSKPGAQLARQIGAS

SEQ ID NO: 7122 - protein, 40 aa, Artificial Sequence
  Description of Artificial Sequence: Synthetic polypeptide
CILTEKRKKRSTKKEVFNILQAAYVSKPGAQLARQIGASL

SEQ ID NO: 7123 - protein, 40 aa, Artificial Sequence
  Description of Artificial Sequence: Synthetic polypeptide
ILTEKRKKRSTKKEVFNILQAAYVSKPGAQLARQIGASLN

SEQ ID NO: 7124 - protein, 40 aa, Artificial Sequence
  Description of Artificial Sequence: Synthetic polypeptide
LTEKRKKRSTKKEVFNILQAAYVSKPGAQLARQIGASLND

SEQ ID NO: 7125 - protein, 40 aa, Artificial Sequence
  Description of Artificial Sequence: Synthetic polypeptide
TEKRKKRSTKKEVFNILQAAYVSKPGAQLARQIGASLNDD

SEQ ID NO: 7126 - protein, 40 aa, Artificial Sequence
  Description of Artificial Sequence: Synthetic polypeptide
EKRKKRSTKKEVFNILQAAYVSKPGAQLARQIGASLNDDI

SEQ ID NO: 7127 - protein, 40 aa, Artificial Sequence
  Description of Artificial Sequence: Synthetic polypeptide
KRKKRSTKKEVFNILQAAYVSKPGAQLARQIGASLNDDIL

SEQ ID NO: 7128 - protein, 40 aa, Artificial Sequence
  Description of Artificial Sequence: Synthetic polypeptide
KKRSTKKEVFNILQAAYVSKPGAQLARQIGASLNDDILFG

SEQ ID NO: 7129 - protein, 40 aa, Artificial Sequence
  Description of Artificial Sequence: Synthetic polypeptide
HFYGPNHEHCFNRTLLRNSSGCEARRDEYRTEFTTALQRV

SEQ ID NO: 7130 - protein, 40 aa, Artificial Sequence
  Description of Artificial Sequence: Synthetic polypeptide
YRTEFTTALQRVDLFMGQFSEVLLTSISTFIKGDLTIANL

SEQ ID NO: 7131 - protein, 40 aa, Artificial Sequence
  Description of Artificial Sequence: Synthetic polypeptide
RVDLFMGQFSEVLLTSISTFIKGDLTIANLGTSEGRFMQV

SEQ ID NO: 7132 - protein, 40 aa, Artificial Sequence
  Description of Artificial Sequence: Synthetic polypeptide
EGRFMQVVVSRSGPSTPHVNFLLDSHPVSPEVIVEHTLNQ

SEQ ID NO: 7133 - protein, 40 aa, Artificial Sequence
  Description of Artificial Sequence: Synthetic polypeptide
QICLPAIYKVFPNSAPLEGGTRLTICGWDFGFRRNNKFDL

SEQ ID NO: 7134 - protein, 40 aa, Artificial Sequence
  Description of Artificial Sequence: Synthetic polypeptide
ICLPAIYKVFPNSAPLEGGTRLTICGWDFGFRRNNKFDLK

SEQ ID NO: 7135 - protein, 40 aa, Artificial Sequence
  Description of Artificial Sequence: Synthetic polypeptide
IYKVFPNSAPLEGGTRLTICGWDFGFRRNNKFDLKKTRVL

SEQ ID NO: 7136 - protein, 40 aa, Artificial Sequence
  Description of Artificial Sequence: Synthetic polypeptide
YKVFPNSAPLEGGTRLTICGWDFGFRRNNKFDLKKTRVLL

SEQ ID NO: 7137 - protein, 40 aa, Artificial Sequence
  Description of Artificial Sequence: Synthetic polypeptide
KVFPNSAPLEGGTRLTICGWDFGFRRNNKFDLKKTRVLLG

SEQ ID NO: 7138 - protein, 40 aa, Artificial Sequence
  Description of Artificial Sequence: Synthetic polypeptide
VFPNSAPLEGGTRLTICGWDFGFRRNNKFDLKKTRVLLGN

SEQ ID NO: 7139 - protein, 40 aa, Artificial Sequence
  Description of Artificial Sequence: Synthetic polypeptide
FPNSAPLEGGTRLTICGWDFGFRRNNKFDLKKTRVLLGNE

SEQ ID NO: 7140 - protein, 40 aa, Artificial Sequence
  Description of Artificial Sequence: Synthetic polypeptide
PNSAPLEGGTRLTICGWDFGFRRNNKFDLKKTRVLLGNES

SEQ ID NO: 7141 - protein, 40 aa, Artificial Sequence
  Description of Artificial Sequence: Synthetic polypeptide
NSAPLEGGTRLTICGWDFGFRRNNKFDLKKTRVLLGNESC

SEQ ID NO: 7142 - protein, 40 aa, Artificial Sequence
  Description of Artificial Sequence: Synthetic polypeptide
SAPLEGGTRLTICGWDFGFRRNNKFDLKKTRVLLGNESCT

SEQ ID NO: 7143 - protein, 40 aa, Artificial Sequence
  Description of Artificial Sequence: Synthetic polypeptide
LEGGTRLTICGWDFGFRRNNKFDLKKTRVLLGNESCTLTL

SEQ ID NO: 7144 - protein, 40 aa, Artificial Sequence
  Description of Artificial Sequence: Synthetic polypeptide
GTRLTICGWDFGFRRNNKFDLKKTRVLLGNESCTLTLSES

SEQ ID NO: 7145 - protein, 40 aa, Artificial Sequence
  Description of Artificial Sequence: Synthetic polypeptide
TRLTICGWDFGFRRNNKFDLKKTRVLLGNESCTLTLSEST

SEQ ID NO: 7146 - protein, 40 aa, Artificial Sequence
  Description of Artificial Sequence: Synthetic polypeptide
RLTICGWDFGFRRNNKFDLKKTRVLLGNESCTLTLSESTM

SEQ ID NO: 7147 - protein, 40 aa, Artificial Sequence
  Description of Artificial Sequence: Synthetic polypeptide
MTICGWDFGFRRNNKFDLKKTRVLLGNESCTLTLSESTMN

SEQ ID NO: 7148 - protein, 40 aa, Artificial Sequence
  Description of Artificial Sequence: Synthetic polypeptide
GWDFGFRRNNKFDLKKTRVLLGNESCTLTLSESTMNTLKC

SEQ ID NO: 7149 - protein, 40 aa, Artificial Sequence
  Description of Artificial Sequence: Synthetic polypeptide
FGFRRNNKFDLKKTRVLLGNESCTLTLSESTMNTLKCTVG

SEQ ID NO: 7150 - protein, 40 aa, Artificial Sequence
  Description of Artificial Sequence: Synthetic polypeptide
GFRRNNKFDLKKTRVLLGNESCTLTLSESTMNTLKCTVGP

SEQ ID NO: 7151 - protein, 40 aa, Artificial Sequence
  Description of Artificial Sequence: Synthetic polypeptide
FRRNNKFDLKKTRVLLGNESCTLTLSESTMNTLKCTVGPA

SEQ ID NO: 7152 - protein, 40 aa, Artificial Sequence
  Description of Artificial Sequence: Synthetic polypeptide
RRNNKFDLKKTRVLLGNESCTLTLSESTMNTLKCTVGPAM

SEQ ID NO: 7153 - protein, 40 aa, Artificial Sequence
  Description of Artificial Sequence: Synthetic polypeptide
RNNKFDLKKTRVLLGNESCTLTLSESTMNTLKCTVGPAMN

SEQ ID NO: 7154 - protein, 40 aa, Artificial Sequence
  Description of Artificial Sequence: Synthetic polypeptide
NNKFDLKKTRVLLGNESCTLTLSESTMNTLKCTVGPAMNK

SEQ ID NO: 7155 - protein, 40 aa, Artificial Sequence
  Description of Artificial Sequence: Synthetic polypeptide
NKFDLKKTRVLLGNESCTLTLSESTMNTLKCTVGPAMNKH

SEQ ID NO: 7156 - protein, 40 aa, Artificial Sequence
  Description of Artificial Sequence: Synthetic polypeptide
KFDLKKTRVLLGNESCTLTLSESTMNTLKCTVGPAMNKHF

SEQ ID NO: 7157 - protein, 40 aa, Artificial Sequence
  Description of Artificial Sequence: Synthetic polypeptide
VLLGNESCTLTLSESTMNTLKCTVGPAMNKHFNMSIIISN

SEQ ID NO: 7158 - protein, 40 aa, Artificial Sequence
  Description of Artificial Sequence: Synthetic polypeptide
GHGTTQYSTFSYVDPVITSISPKYGPMAGGTLLTLTGNYL

SEQ ID NO: 7159 - protein, 40 aa, Artificial Sequence
  Description of Artificial Sequence: Synthetic polypeptide
GTTQYSTFSYVDPVITSISPKYGPMAGGTLLTLTGNYLNS

SEQ ID NO: 7160 - protein, 40 aa, Artificial Sequence
  Description of Artificial Sequence: Synthetic polypeptide
TFSYVDPVITSISPKYGPMAGGTLLTLTGNYLNSGNSRHI

SEQ ID NO: 7161 - protein, 40 aa, Artificial Sequence
  Description of Artificial Sequence: Synthetic polypeptide
FSYVDPVITSISPKYGPMAGGTLLTLTGNYLNSGNSRHIS

SEQ ID NO: 7162 - protein, 40 aa, Artificial Sequence
  Description of Artificial Sequence: Synthetic polypeptide
SYVDPVITSISPKYGPMAGGTLLTLTGNYLNSGNSRHISI

SEQ ID NO: 7163 - protein, 40 aa, Artificial Sequence
  Description of Artificial Sequence: Synthetic polypeptide
PVITSISPKYGPMAGGTLLTLTGNYLNSGNSRHISIGGKT

SEQ ID NO: 7164 - protein, 40 aa, Artificial Sequence
  Description of Artificial Sequence: Synthetic polypeptide
TSISPKYGPMAGGTLLTLTGNYLNSGNSRHISIGGKTCTL

SEQ ID NO: 7165 - protein, 40 aa, Artificial Sequence
  Description of Artificial Sequence: Synthetic polypeptide
SISPKYGPMAGGTLLTLTGNYLNSGNSRHISIGGKTCTLK

SEQ ID NO: 7166 - protein, 40 aa, Artificial Sequence
  Description of Artificial Sequence: Synthetic polypeptide
PKYGPMAGGTLLTLTGNYLNSGNSRHISIGGKTCTLKSVS

SEQ ID NO: 7167 - protein, 40 aa, Artificial Sequence
  Description of Artificial Sequence: Synthetic polypeptide
MAGGTLLTLTGNYLNSGNSRHISIGGKTCTLKSVSNSILE

SEQ ID NO: 7168 - protein, 40 aa, Artificial Sequence
  Description of Artificial Sequence: Synthetic polypeptide
AGGTLLTLTGNYLNSGNSRHISIGGKTCTLKSVSNSILEC

SEQ ID NO: 7169 - protein, 40 aa, Artificial Sequence
  Description of Artificial Sequence: Synthetic polypeptide
TLLTLTGNYLNSGNSRHISIGGKTCTLKSVSNSILECYTP

SEQ ID NO: 7170 - protein, 40 aa, Artificial Sequence
  Description of Artificial Sequence: Synthetic polypeptide
LLTLTGNYLNSGNSRHISIGGKTCTLKSVSNSILECYTPA

SEQ ID NO: 7171 - protein, 40 aa, Artificial Sequence
  Description of Artificial Sequence: Synthetic polypeptide
NSRHISIGGKTCTLKSVSNSILECYTPAQTISTEFAVKLK

SEQ ID NO: 7172 - protein, 40 aa, Artificial Sequence
  Description of Artificial Sequence: Synthetic polypeptide
SRHISIGGKTCTLKSVSNSILECYTPAQTISTEFAVKLKI

SEQ ID NO: 7173 - protein, 40 aa, Artificial Sequence
  Description of Artificial Sequence: Synthetic polypeptide
RHISIGGKTCTLKSVSNSILECYTPAQTISTEFAVKLKID

SEQ ID NO: 7174 - protein, 40 aa, Artificial Sequence
  Description of Artificial Sequence: Synthetic polypeptide
HISIGGKTCTLKSVSNSILECYTPAQTISTEFAVKLKIDL

SEQ ID NO: 7175 - protein, 40 aa, Artificial Sequence
  Description of Artificial Sequence: Synthetic polypeptide
ISIGGKTCTLKSVSNSILECYTPAQTISTEFAVKLKIDLA

SEQ ID NO: 7176 - protein, 40 aa, Artificial Sequence
  Description of Artificial Sequence: Synthetic polypeptide
SIGGKTCTLKSVSNSILECYTPAQTISTEFAVKLKIDLAN

SEQ ID NO: 7177 - protein, 40 aa, Artificial Sequence
  Description of Artificial Sequence: Synthetic polypeptide
IGGKTCTLKSVSNSILECYTPAQTISTEFAVKLKIDLANR

SEQ ID NO: 7178 - protein, 40 aa, Artificial Sequence
  Description of Artificial Sequence: Synthetic polypeptide
GGKTCTLKSVSNSILECYTPAQTISTEFAVKLKIDLANRE

SEQ ID NO: 7179 - protein, 40 aa, Artificial Sequence
  Description of Artificial Sequence: Synthetic polypeptide
TCTLKSVSNSILECYTPAQTISTEFAVKLKIDLANRETSI

SEQ ID NO: 7180 - protein, 40 aa, Artificial Sequence
  Description of Artificial Sequence: Synthetic polypeptide
TLKSVSNSILECYTPAQTISTEFAVKLKIDLANRETSIFS

SEQ ID NO: 7181 - protein, 40 aa, Artificial Sequence
  Description of Artificial Sequence: Synthetic polypeptide
TISTEFAVKLKIDLANRETSIFSYREDPIVYEIHPTKSFI

SEQ ID NO: 7182 - protein, 40 aa, Artificial Sequence
  Description of Artificial Sequence: Synthetic polypeptide
AVKLKIDLANRETSIFSYREDPIVYEIHPTKSFISGGSTI

SEQ ID NO: 7183 - protein, 40 aa, Artificial Sequence
  Description of Artificial Sequence: Synthetic polypeptide
VKLKIDLANRETSIFSYREDPIVYEIHPTKSFISGGSTIT

SEQ ID NO: 7184 - protein, 40 aa, Artificial Sequence
  Description of Artificial Sequence: Synthetic polypeptide
DLANRETSIFSYREDPIVYEIHPTKSFISGGSTITGVGKN

SEQ ID NO: 7185 - protein, 40 aa, Artificial Sequence
  Description of Artificial Sequence: Synthetic polypeptide
TSIFSYREDPIVYEIHPTKSFISGGSTITGVGKNLNSVSV

SEQ ID NO: 7186 - protein, 40 aa, Artificial Sequence
  Description of Artificial Sequence: Synthetic polypeptide
TITGVGKNLNSVSVPRMVINVHEAGRNFTVACQHRSNSEI

SEQ ID NO: 7187 - protein, 40 aa, Artificial Sequence
  Description of Artificial Sequence: Synthetic polypeptide
MNSVSVPRMVINVHEAGRNFTVACQHRSNSEIICCTTPSL

SEQ ID NO: 7188 - protein, 40 aa, Artificial Sequence
  Description of Artificial Sequence: Synthetic polypeptide
SVSVPRMVINVHEAGRNFTVACQHRSNSEIICCTTPSLQQ

SEQ ID NO: 7189 - protein, 40 aa, Artificial Sequence
  Description of Artificial Sequence: Synthetic polypeptide
SVPRMVINVHEAGRNFTVACQHRSNSEIICCTTPSLQQLN

SEQ ID NO: 7190 - protein, 40 aa, Artificial Sequence
  Description of Artificial Sequence: Synthetic polypeptide
NFTVACQHRSNSEIICCTTPSLQQLNLQLPLKTKAFFMLD

SEQ ID NO: 7191 - protein, 40 aa, Artificial Sequence
  Description of Artificial Sequence: Synthetic polypeptide
VACQHRSNSEIICCTTPSLQQLNLQLPLKTKAFFMLDGIL

SEQ ID NO: 7192 - protein, 40 aa, Artificial Sequence
  Description of Artificial Sequence: Synthetic polypeptide
QQLNLQLPLKTKAFFMLDGILSKYFDLIYVHNPVFKPFEK

SEQ ID NO: 7193 - protein, 40 aa, Artificial Sequence
  Description of Artificial Sequence: Synthetic polypeptide
QLNLQLPLKTKAFFMLDGILSKYFDLIYVHNPVFKPFEKP

SEQ ID NO: 7194 - protein, 40 aa, Artificial Sequence
  Description of Artificial Sequence: Synthetic polypeptide
MNLQLPLKTKAFFMLDGILSKYFDLIYVHNPVFKPFEKPV

SEQ ID NO: 7195 - protein, 40 aa, Artificial Sequence
  Description of Artificial Sequence: Synthetic polypeptide
MQLPLKTKAFFMLDGILSKYFDLIYVHNPVFKPFEKPVMI

SEQ ID NO: 7196 - protein, 40 aa, Artificial Sequence
  Description of Artificial Sequence: Synthetic polypeptide
LPLKTKAFFMLDGILSKYFDLIYVHNPVFKPFEKPVMISM

SEQ ID NO: 7197 - protein, 40 aa, Artificial Sequence
  Description of Artificial Sequence: Synthetic polypeptide
MKTKAFFMLDGILSKYFDLIYVHNPVFKPFEKPVMISMGN

SEQ ID NO: 7198 - protein, 40 aa, Artificial Sequence
  Description of Artificial Sequence: Synthetic polypeptide
TKAFFMLDGILSKYFDLIYVHNPVFKPFEKPVMISMGNEN

SEQ ID NO: 7199 - protein, 40 aa, Artificial Sequence
  Description of Artificial Sequence: Synthetic polypeptide
KAFFMLDGILSKYFDLIYVHNPVFKPFEKPVMISMGNENV

SEQ ID NO: 7200 - protein, 40 aa, Artificial Sequence
  Description of Artificial Sequence: Synthetic polypeptide
FMLDGILSKYFDLIYVHNPVFKPFEKPVMISMGNENVLEI

SEQ ID NO: 7201 - protein, 40 aa, Artificial Sequence
  Description of Artificial Sequence: Synthetic polypeptide
LDGILSKYFDLIYVHNPVFKPFEKPVMISMGNENVLEIKG

SEQ ID NO: 7202 - protein, 40 aa, Artificial Sequence
  Description of Artificial Sequence: Synthetic polypeptide
ILSKYFDLIYVHNPVFKPFEKPVMISMGNENVLEIKGNDI

SEQ ID NO: 7203 - protein, 40 aa, Artificial Sequence
  Description of Artificial Sequence: Synthetic polypeptide
LSKYFDLIYVHNPVFKPFEKPVMISMGNENVLEIKGNDID

SEQ ID NO: 7204 - protein, 40 aa, Artificial Sequence
  Description of Artificial Sequence: Synthetic polypeptide
SKYFDLIYVHNPVFKPFEKPVMISMGNENVLEIKGNDIDP

SEQ ID NO: 7205 - protein, 40 aa, Artificial Sequence
  Description of Artificial Sequence: Synthetic polypeptide
DLIYVHNPVFKPFEKPVMISMGNENVLEIKGNDIDPEAVK

SEQ ID NO: 7206 - protein, 40 aa, Artificial Sequence
  Description of Artificial Sequence: Synthetic polypeptide
LIYVHNPVFKPFEKPVMISMGNENVLEIKGNDIDPEAVKG

SEQ ID NO: 7207 - protein, 40 aa, Artificial Sequence
  Description of Artificial Sequence: Synthetic polypeptide
IYVHNPVFKPFEKPVMISMGNENVLEIKGNDIDPEAVKGE

SEQ ID NO: 7208 - protein, 40 aa, Artificial Sequence
  Description of Artificial Sequence: Synthetic polypeptide
HNPVFKPFEKPVMISMGNENVLEIKGNDIDPEAVKGEVLK

SEQ ID NO: 7209 - protein, 40 aa, Artificial Sequence
  Description of Artificial Sequence: Synthetic polypeptide
NPVFKPFEKPVMISMGNENVLEIKGNDIDPEAVKGEVLKV

SEQ ID NO: 7210 - protein, 40 aa, Artificial Sequence
  Description of Artificial Sequence: Synthetic polypeptide
KPFEKPVMISMGNENVLEIKGNDIDPEAVKGEVLKVGNKS

SEQ ID NO: 7211 - protein, 40 aa, Artificial Sequence
  Description of Artificial Sequence: Synthetic polypeptide
PFEKPVMISMGNENVLEIKGNDIDPEAVKGEVLKVGNKSC

SEQ ID NO: 7212 - protein, 40 aa, Artificial Sequence
  Description of Artificial Sequence: Synthetic polypeptide
FEKPVMISMGNENVLEIKGNDIDPEAVKGEVLKVGNKSCE

SEQ ID NO: 7213 - protein, 40 aa, Artificial Sequence
  Description of Artificial Sequence: Synthetic polypeptide
MGNENVLEIKGNDIDPEAVKGEVLKVGNKSCENIHLHSEA

SEQ ID NO: 7214 - protein, 40 aa, Artificial Sequence
  Description of Artificial Sequence: Synthetic polypeptide
NVLEIKGNDIDPEAVKGEVLKVGNKSCENIHLHSEAVLCT

SEQ ID NO: 7215 - protein, 40 aa, Artificial Sequence
  Description of Artificial Sequence: Synthetic polypeptide
EIKGNDIDPEAVKGEVLKVGNKSCENIHLHSEAVLCTVPN

SEQ ID NO: 7216 - protein, 40 aa, Artificial Sequence
  Description of Artificial Sequence: Synthetic polypeptide
NDIDPEAVKGEVLKVGNKSCENIHLHSEAVLCTVPNDLLK

SEQ ID NO: 7217 - protein, 40 aa, Artificial Sequence
  Description of Artificial Sequence: Synthetic polypeptide
DIDPEAVKGEVLKVGNKSCENIHLHSEAVLCTVPNDLLKL

SEQ ID NO: 7218 - protein, 40 aa, Artificial Sequence
  Description of Artificial Sequence: Synthetic polypeptide
IHLHSEAVLCTVPNDLLKLNSELNIEWKQAISSTVLGKVI

SEQ ID NO: 7219 - protein, 40 aa, Artificial Sequence
  Description of Artificial Sequence: Synthetic polypeptide
HLHSEAVLCTVPNDLLKLNSELNIEWKQAISSTVLGKVIV

SEQ ID NO: 7220 - protein, 40 aa, Artificial Sequence
  Description of Artificial Sequence: Synthetic polypeptide
IVQPDQNFTGLIAGVVSISTALLLLLGFFLWLKKRKQIKD

SEQ ID NO: 7221 - protein, 40 aa, Artificial Sequence
  Description of Artificial Sequence: Synthetic polypeptide
VQPDQNFTGLIAGVVSISTALLLLLGFFLWLKKRKQIKDL

SEQ ID NO: 7222 - protein, 40 aa, Artificial Sequence
  Description of Artificial Sequence: Synthetic polypeptide
PDQNFTGLIAGVVSISTALLLLLGFFLWLKKRKQIKDLGS

SEQ ID NO: 7223 - protein, 40 aa, Artificial Sequence
  Description of Artificial Sequence: Synthetic polypeptide
DQNFTGLIAGVVSISTALLLLLGFFLWLKKRKQIKDLGSE

SEQ ID NO: 7224 - protein, 40 aa, Artificial Sequence
  Description of Artificial Sequence: Synthetic polypeptide
GLIAGVVSISTALLLLLGFFLWLKKRKQIKDLGSELVRYD

SEQ ID NO: 7225 - protein, 40 aa, Artificial Sequence
  Description of Artificial Sequence: Synthetic polypeptide
LLLLGFFLWLKKRKQIKDLGSELVRYDARVHTPHLDRLVS

SEQ ID NO: 7226 - protein, 40 aa, Artificial Sequence
  Description of Artificial Sequence: Synthetic polypeptide
KKRKQIKDLGSELVRYDARVHTPHLDRLVSARSVSPTTEM

SEQ ID NO: 7227 - protein, 40 aa, Artificial Sequence
  Description of Artificial Sequence: Synthetic polypeptide
ELVRYDARVHTPHLDRLVSARSVSPTTEMVSNESVDYRAT

SEQ ID NO: 7228 - protein, 40 aa, Artificial Sequence
  Description of Artificial Sequence: Synthetic polypeptide
LVRYDARVHTPHLDRLVSARSVSPTTEMVSNESVDYRATF

SEQ ID NO: 7229 - protein, 40 aa, Artificial Sequence
  Description of Artificial Sequence: Synthetic polypeptide
VRYDARVHTPHLDRLVSARSVSPTTEMVSNESVDYRATFP

SEQ ID NO: 7230 - protein, 40 aa, Artificial Sequence
  Description of Artificial Sequence: Synthetic polypeptide
RVHTPHLDRLVSARSVSPTTEMVSNESVDYRATFPEDQFP

SEQ ID NO: 7231 - protein, 40 aa, Artificial Sequence
  Description of Artificial Sequence: Synthetic polypeptide
HLDRLVSARSVSPTTEMVSNESVDYRATFPEDQFPNSSQN

SEQ ID NO: 7232 - protein, 40 aa, Artificial Sequence
  Description of Artificial Sequence: Synthetic polypeptide
MDRLVSARSVSPTTEMVSNESVDYRATFPEDQFPNSSQNG

SEQ ID NO: 7233 - protein, 40 aa, Artificial Sequence
  Description of Artificial Sequence: Synthetic polypeptide
RLVSARSVSPTTEMVSNESVDYRATFPEDQFPNSSQNGSC

SEQ ID NO: 7234 - protein, 40 aa, Artificial Sequence
  Description of Artificial Sequence: Synthetic polypeptide
VSARSVSPTTEMVSNESVDYRATFPEDQFPNSSQNGSCRQ

SEQ ID NO: 7235 - protein, 40 aa, Artificial Sequence
  Description of Artificial Sequence: Synthetic polypeptide
VSPTTEMVSNESVDYRATFPEDQFPNSSQNGSCRQVQYPL

SEQ ID NO: 7236 - protein, 40 aa, Artificial Sequence
  Description of Artificial Sequence: Synthetic polypeptide
HIDLSALNPELVQAVQHVVIGPSSLIVHFNEVIGRGHFGC

SEQ ID NO: 7237 - protein, 40 aa, Artificial Sequence
  Description of Artificial Sequence: Synthetic polypeptide
DLSALNPELVQAVQHVVIGPSSLIVHFNEVIGRGHFGCVY

SEQ ID NO: 7238 - protein, 40 aa, Artificial Sequence
  Description of Artificial Sequence: Synthetic polypeptide
HVVIGPSSLIVHFNEVIGRGHFGCVYHGTLLDNDGKKIHC

SEQ ID NO: 7239 - protein, 40 aa, Artificial Sequence
  Description of Artificial Sequence: Synthetic polypeptide
PSSLIVHFNEVIGRGHFGCVYHGTLLDNDGKKIHCAVKSL

SEQ ID NO: 7240 - protein, 40 aa, Artificial Sequence
  Description of Artificial Sequence: Synthetic polypeptide
GRGHFGCVYHGTLLDNDGKKIHCAVKSLNRITDIGEVSQF

SEQ ID NO: 7241 - protein, 40 aa, Artificial Sequence
  Description of Artificial Sequence: Synthetic polypeptide
FGCVYHGTLLDNDGKKIHCAVKSLNRITDIGEVSQFLTEG

SEQ ID NO: 7242 - protein, 40 aa, Artificial Sequence
  Description of Artificial Sequence: Synthetic polypeptide
YHGTLLDNDGKKIHCAVKSLNRITDIGEVSQFLTEGIIMK

SEQ ID NO: 7243 - protein, 40 aa, Artificial Sequence
  Description of Artificial Sequence: Synthetic polypeptide
HGDLRNFIRNETHNPTVKDLIGFGLQVAKGMKYLASKKFV

SEQ ID NO: 7244 - protein, 40 aa, Artificial Sequence
  Description of Artificial Sequence: Synthetic polypeptide
LRNFIRNETHNPTVKDLIGFGLQVAKGMKYLASKKFVHRD

SEQ ID NO: 7245 - protein, 40 aa, Artificial Sequence
  Description of Artificial Sequence: Synthetic polypeptide
RNETHNPTVKDLIGFGLQVAKGMKYLASKKFVHRDLAARN

SEQ ID NO: 7246 - protein, 40 aa, Artificial Sequence
  Description of Artificial Sequence: Synthetic polypeptide
NETHNPTVKDLIGFGLQVAKGMKYLASKKFVHRDLAARNC

SEQ ID NO: 7247 - protein, 40 aa, Artificial Sequence
  Description of Artificial Sequence: Synthetic polypeptide
DFGLARDMYDKEYYSVHNKTGAKLPVKWMALESLQTQKFT

SEQ ID NO: 7248 - protein, 40 aa, Artificial Sequence
  Description of Artificial Sequence: Synthetic polypeptide
MYDKEYYSVHNKTGAKLPVKWMALESLQTQKFTTKSDVWS

SEQ ID NO: 7249 - protein, 40 aa, Artificial Sequence
  Description of Artificial Sequence: Synthetic polypeptide
YDKEYYSVHNKTGAKLPVKWMALESLQTQKFTTKSDVWSF

SEQ ID NO: 7250 - protein, 40 aa, Artificial Sequence
  Description of Artificial Sequence: Synthetic polypeptide
QKFTTKSDVWSFGVLLWELMTRGAPPYPDVNTFDITVYLL

SEQ ID NO: 7251 - protein, 40 aa, Artificial Sequence
  Description of Artificial Sequence: Synthetic polypeptide
VWSFGVLLWELMTRGAPPYPDVNTFDITVYLLQGRRLLQP

SEQ ID NO: 7252 - protein, 40 aa, Artificial Sequence
  Description of Artificial Sequence: Synthetic polypeptide
WSFGVLLWELMTRGAPPYPDVNTFDITVYLLQGRRLLQPE

SEQ ID NO: 7253 - protein, 40 aa, Artificial Sequence
  Description of Artificial Sequence: Synthetic polypeptide
FGVLLWELMTRGAPPYPDVNTFDITVYLLQGRRLLQPEYC

SEQ ID NO: 7254 - protein, 40 aa, Artificial Sequence
  Description of Artificial Sequence: Synthetic polypeptide
GVLLWELMTRGAPPYPDVNTFDITVYLLQGRRLLQPEYCP

SEQ ID NO: 7255 - protein, 40 aa, Artificial Sequence
  Description of Artificial Sequence: Synthetic polypeptide
LLWELMTRGAPPYPDVNTFDITVYLLQGRRLLQPEYCPDP

SEQ ID NO: 7256 - protein, 40 aa, Artificial Sequence
  Description of Artificial Sequence: Synthetic polypeptide
LWELMTRGAPPYPDVNTFDITVYLLQGRRLLQPEYCPDPL

SEQ ID NO: 7257 - protein, 40 aa, Artificial Sequence
  Description of Artificial Sequence: Synthetic polypeptide
WELMTRGAPPYPDVNTFDITVYLLQGRRLLQPEYCPDPLY

SEQ ID NO: 7258 - protein, 40 aa, Artificial Sequence
  Description of Artificial Sequence: Synthetic polypeptide
ELMTRGAPPYPDVNTFDITVYLLQGRRLLQPEYCPDPLYE

SEQ ID NO: 7259 - protein, 40 aa, Artificial Sequence
  Description of Artificial Sequence: Synthetic polypeptide
MMTRGAPPYPDVNTFDITVYLLQGRRLLQPEYCPDPLYEV

SEQ ID NO: 7260 - protein, 40 aa, Artificial Sequence
  Description of Artificial Sequence: Synthetic polypeptide
MTRGAPPYPDVNTFDITVYLLQGRRLLQPEYCPDPLYEVM

SEQ ID NO: 7261 - protein, 40 aa, Artificial Sequence
  Description of Artificial Sequence: Synthetic polypeptide
TRGAPPYPDVNTFDITVYLLQGRRLLQPEYCPDPLYEVML

SEQ ID NO: 7262 - protein, 40 aa, Artificial Sequence
  Description of Artificial Sequence: Synthetic polypeptide
RGAPPYPDVNTFDITVYLLQGRRLLQPEYCPDPLYEVMLK

SEQ ID NO: 7263 - protein, 40 aa, Artificial Sequence
  Description of Artificial Sequence: Synthetic polypeptide
APPYPDVNTFDITVYLLQGRRLLQPEYCPDPLYEVMLKCW

SEQ ID NO: 7264 - protein, 40 aa, Artificial Sequence
  Description of Artificial Sequence: Synthetic polypeptide
QPEYCPDPLYEVMLKCWHPKAEMRPSFSELVSRISAIFST

SEQ ID NO: 7265 - protein, 40 aa, Artificial Sequence
  Description of Artificial Sequence: Synthetic polypeptide
PEYCPDPLYEVMLKCWHPKAEMRPSFSELVSRISAIFSTF

SEQ ID NO: 7266 - protein, 40 aa, Artificial Sequence
  Description of Artificial Sequence: Synthetic polypeptide
RPSFSELVSRISAIFSTFIGEHYVHVNATYVNVKCVAPYP

SEQ ID NO: 7267 - protein, 40 aa, Artificial Sequence
  Description of Artificial Sequence: Synthetic polypeptide
SFSELVSRISAIFSTFIGEHYVHVNATYVNVKCVAPYPSL

SEQ ID NO: 7268 - protein, 40 aa, Artificial Sequence
  Description of Artificial Sequence: Synthetic polypeptide
FSELVSRISAIFSTFIGEHYVHVNATYVNVKCVAPYPSLL

SEQ ID NO: 7269 - protein, 40 aa, Artificial Sequence
  Description of Artificial Sequence: Synthetic polypeptide
SELVSRISAIFSTFIGEHYVHVNATYVNVKCVAPYPSLLS

SEQ ID NO: 7270 - protein, 40 aa, Artificial Sequence
  Description of Artificial Sequence: Synthetic polypeptide
VSRISAIFSTFIGEHYVHVNATYVNVKCVAPYPSLLSSED

SEQ ID NO: 7271 - protein, 40 aa, Artificial Sequence
  Description of Artificial Sequence: Synthetic polypeptide
SRISAIFSTFIGEHYVHVNATYVNVKCVAPYPSLLSSEDN

SEQ ID NO: 7272 - protein, 40 aa, Artificial Sequence
  Description of Artificial Sequence: Synthetic polypeptide
IGEHYVHVNATYVNVKCVAPYPSLLSSEDNADDEVDTRPA

SEQ ID NO: 7273 - protein, 40 aa, Artificial Sequence
  Description of Artificial Sequence: Synthetic polypeptide
HYVHVNATYVNVKCVAPYPSLLSSEDNADDEVDTRPASFW

SEQ ID NO: 7274 - protein, 40 aa, Artificial Sequence
  Description of Artificial Sequence: Synthetic polypeptide
AAATTAATTSSNVSVLQQFASGLKSRNEETRAKAAKELQH

SEQ ID NO: 7275 - protein, 40 aa, Artificial Sequence
  Description of Artificial Sequence: Synthetic polypeptide
QFASGLKSRNEETRAKAAKELQHYVTMELREMSQEESTRF

SEQ ID NO: 7276 - protein, 40 aa, Artificial Sequence
  Description of Artificial Sequence: Synthetic polypeptide
FASGLKSRNEETRAKAAKELQHYVTMELREMSQEESTRFY

SEQ ID NO: 7277 - protein, 40 aa, Artificial Sequence
  Description of Artificial Sequence: Synthetic polypeptide
SGLKSRNEETRAKAAKELQHYVTMELREMSQEESTRFYDQ

SEQ ID NO: 7278 - protein, 40 aa, Artificial Sequence
  Description of Artificial Sequence: Synthetic polypeptide
LQHYVTMELREMSQEESTRFYDQLNHHIFELVSSSDANER

SEQ ID NO: 7279 - protein, 40 aa, Artificial Sequence
  Description of Artificial Sequence: Synthetic polypeptide
ELREMSQEESTRFYDQLNHHIFELVSSSDANERKGGILAI

SEQ ID NO: 7280 - protein, 40 aa, Artificial Sequence
  Description of Artificial Sequence: Synthetic polypeptide
ALEWLGADRNEGRRHAAVLVLRELAISVPTFFFQQVQPFF

SEQ ID NO: 7281 - protein, 40 aa, Artificial Sequence
  Description of Artificial Sequence: Synthetic polypeptide
EGRRHAAVLVLRELAISVPTFFFQQVQPFFDNIFVAVWDP

SEQ ID NO: 7282 - protein, 40 aa, Artificial Sequence
  Description of Artificial Sequence: Synthetic polypeptide
QQVQPFFDNIFVAVWDPKQAIREGAVAALRACLILTTQRE

SEQ ID NO: 7283 - protein, 40 aa, Artificial Sequence
  Description of Artificial Sequence: Synthetic polypeptide
RDDRIHGALLILNELVRISSMEGERLREEMEEITQQQLVH

SEQ ID NO: 7284 - protein, 40 aa, Artificial Sequence
  Description of Artificial Sequence: Synthetic polypeptide
YSSHQGLMGFGTSPSPAKSTLVESRCCRDLMEEKFDQVCQ

SEQ ID NO: 7285 - protein, 40 aa, Artificial Sequence
  Description of Artificial Sequence: Synthetic polypeptide
LMGFGTSPSPAKSTLVESRCCRDLMEEKFDQVCQWVLKCR

SEQ ID NO: 7286 - protein, 40 aa, Artificial Sequence
  Description of Artificial Sequence: Synthetic polypeptide
PSPAKSTLVESRCCRDLMEEKFDQVCQWVLKCRNSKNSLI

SEQ ID NO: 7287 - protein, 40 aa, Artificial Sequence
  Description of Artificial Sequence: Synthetic polypeptide
MVESRCCRDLMEEKFDQVCQWVLKCRNSKNSLIQMTILNL

SEQ ID NO: 7288 - protein, 40 aa, Artificial Sequence
  Description of Artificial Sequence: Synthetic polypeptide
CVKKEKERTAAFQALGLLSVAVRSEFKVYLPRVLDIIRAA

SEQ ID NO: 7289 - protein, 40 aa, Artificial Sequence
  Description of Artificial Sequence: Synthetic polypeptide
ERTAAFQALGLLSVAVRSEFKVYLPRVLDIIRAALPPKDF

SEQ ID NO: 7290 - protein, 40 aa, Artificial Sequence
  Description of Artificial Sequence: Synthetic polypeptide
TAAFQALGLLSVAVRSEFKVYLPRVLDIIRAALPPKDFAH

SEQ ID NO: 7291 - protein, 40 aa, Artificial Sequence
  Description of Artificial Sequence: Synthetic polypeptide
AAFQALGLLSVAVRSEFKVYLPRVLDIIRAALPPKDFAHK

SEQ ID NO: 7292 - protein, 40 aa, Artificial Sequence
  Description of Artificial Sequence: Synthetic polypeptide
AFQALGLLSVAVRSEFKVYLPRVLDIIRAALPPKDFAHKR

SEQ ID NO: 7293 - protein, 40 aa, Artificial Sequence
  Description of Artificial Sequence: Synthetic polypeptide
AMQVDATVFTCISMLARAMGPGIQQDIKELLEPMLAVGLS

SEQ ID NO: 7294 - protein, 40 aa, Artificial Sequence
  Description of Artificial Sequence: Synthetic polypeptide
QVDATVFTCISMLARAMGPGIQQDIKELLEPMLAVGLSPA

SEQ ID NO: 7295 - protein, 40 aa, Artificial Sequence
  Description of Artificial Sequence: Synthetic polypeptide
GHAHVVSQTAVQVVADVLSKLLVVGITDPDPDIRYCVLAS

SEQ ID NO: 7296 - protein, 40 aa, Artificial Sequence
  Description of Artificial Sequence: Synthetic polypeptide
HAHVVSQTAVQVVADVLSKLLVVGITDPDPDIRYCVLASL

SEQ ID NO: 7297 - protein, 40 aa, Artificial Sequence
  Description of Artificial Sequence: Synthetic polypeptide
VLSKLLVVGITDPDPDIRYCVLASLDERFDAHLAQAENLQ

SEQ ID NO: 7298 - protein, 40 aa, Artificial Sequence
  Description of Artificial Sequence: Synthetic polypeptide
PYMEPILKALILKLKDPDPDPNPGVINNVLATIGELAQVS

SEQ ID NO: 7299 - protein, 40 aa, Artificial Sequence
  Description of Artificial Sequence: Synthetic polypeptide
YMEPILKALILKLKDPDPDPNPGVINNVLATIGELAQVSG

SEQ ID NO: 7300 - protein, 40 aa, Artificial Sequence
  Description of Artificial Sequence: Synthetic polypeptide
KALILKLKDPDPDPNPGVINNVLATIGELAQVSGLEMRKW

SEQ ID NO: 7301 - protein, 40 aa, Artificial Sequence
  Description of Artificial Sequence: Synthetic polypeptide
LILKLKDPDPDPNPGVINNVLATIGELAQVSGLEMRKWVD

SEQ ID NO: 7302 - protein, 40 aa, Artificial Sequence
  Description of Artificial Sequence: Synthetic polypeptide
ILKLKDPDPDPNPGVINNVLATIGELAQVSGLEMRKWVDE

SEQ ID NO: 7303 - protein, 40 aa, Artificial Sequence
  Description of Artificial Sequence: Synthetic polypeptide
MKLKDPDPDPNPGVINNVLATIGELAQVSGLEMRKWVDEL

SEQ ID NO: 7304 - protein, 40 aa, Artificial Sequence
  Description of Artificial Sequence: Synthetic polypeptide
KLKDPDPDPNPGVINNVLATIGELAQVSGLEMRKWVDELF

SEQ ID NO: 7305 - protein, 40 aa, Artificial Sequence
  Description of Artificial Sequence: Synthetic polypeptide
KDPDPDPNPGVINNVLATIGELAQVSGLEMRKWVDELFII

SEQ ID NO: 7306 - protein, 40 aa, Artificial Sequence
  Description of Artificial Sequence: Synthetic polypeptide
DPDPDPNPGVINNVLATIGELAQVSGLEMRKWVDELFIII

SEQ ID NO: 7307 - protein, 40 aa, Artificial Sequence
  Description of Artificial Sequence: Synthetic polypeptide
PDPNPGVINNVLATIGELAQVSGLEMRKWVDELFIIIMDM

SEQ ID NO: 7308 - protein, 40 aa, Artificial Sequence
  Description of Artificial Sequence: Synthetic polypeptide
VLATIGELAQVSGLEMRKWVDELFIIIMDMLQDSSLLAKR

SEQ ID NO: 7309 - protein, 40 aa, Artificial Sequence
  Description of Artificial Sequence: Synthetic polypeptide
GELAQVSGLEMRKWVDELFIIIMDMLQDSSLLAKRQVALW

SEQ ID NO: 7310 - protein, 40 aa, Artificial Sequence
  Description of Artificial Sequence: Synthetic polypeptide
FIIIMDMLQDSSLLAKRQVALWTLGQLVASTGYVVEPYRK

SEQ ID NO: 7311 - protein, 40 aa, Artificial Sequence
  Description of Artificial Sequence: Synthetic polypeptide
TLLEVLLNFLKTEQNQGTRREAIRVLGLLGALDPYKHKVN

SEQ ID NO: 7312 - protein, 40 aa, Artificial Sequence
  Description of Artificial Sequence: Synthetic polypeptide
SSQDSSDYSTSEMLVNMGNLPLDEFYPAVSMVALMRIFRD

SEQ ID NO: 7313 - protein, 40 aa, Artificial Sequence
  Description of Artificial Sequence: Synthetic polypeptide
SDYSTSEMLVNMGNLPLDEFYPAVSMVALMRIFRDQSLSH

SEQ ID NO: 7314 - protein, 40 aa, Artificial Sequence
  Description of Artificial Sequence: Synthetic polypeptide
DYSTSEMLVNMGNLPLDEFYPAVSMVALMRIFRDQSLSHH

SEQ ID NO: 7315 - protein, 40 aa, Artificial Sequence
  Description of Artificial Sequence: Synthetic polypeptide
MGNLPLDEFYPAVSMVALMRIFRDQSLSHHHTMVVQAITF

SEQ ID NO: 7316 - protein, 40 aa, Artificial Sequence
  Description of Artificial Sequence: Synthetic polypeptide
RVCDGAIREFLFQQLGMLVSFVKSHIRPYMDEIVTLMREF

SEQ ID NO: 7317 - protein, 40 aa, Artificial Sequence
  Description of Artificial Sequence: Synthetic polypeptide
RSTAMDTLSSLVFQLGKKYQIFIPMVNKVLVRHRINHQRY

SEQ ID NO: 7318 - protein, 40 aa, Artificial Sequence
  Description of Artificial Sequence: Synthetic polypeptide
AMDTLSSLVFQLGKKYQIFIPMVNKVLVRHRINHQRYDVL

SEQ ID NO: 7319 - protein, 40 aa, Artificial Sequence
  Description of Artificial Sequence: Synthetic polypeptide
MSSLVFQLGKKYQIFIPMVNKVLVRHRINHQRYDVLICRI

SEQ ID NO: 7320 - protein, 40 aa, Artificial Sequence
  Description of Artificial Sequence: Synthetic polypeptide
MVRHRINHQRYDVLICRIVKGYTLADEEEDPLIYQHRMLR

SEQ ID NO: 7321 - protein, 40 aa, Artificial Sequence
  Description of Artificial Sequence: Synthetic polypeptide
RMLRSGQGDALASGPVETGPMKKLHVSTINLQKAWGAARR

SEQ ID NO: 7322 - protein, 40 aa, Artificial Sequence
  Description of Artificial Sequence: Synthetic polypeptide
MLRSGQGDALASGPVETGPMKKLHVSTINLQKAWGAARRV

SEQ ID NO: 7323 - protein, 40 aa, Artificial Sequence
  Description of Artificial Sequence: Synthetic polypeptide
SGQGDALASGPVETGPMKKLHVSTINLQKAWGAARRVSKD

SEQ ID NO: 7324 - protein, 40 aa, Artificial Sequence
  Description of Artificial Sequence: Synthetic polypeptide
TSQDIAEVTQTLLNLAEFMEHSDKGPLPLRDDNGIVLLGE

SEQ ID NO: 7325 - protein, 40 aa, Artificial Sequence
  Description of Artificial Sequence: Synthetic polypeptide
MAEFMEHSDKGPLPLRDDNGIVLLGERAAKCRAYAKALHY

SEQ ID NO: 7326 - protein, 40 aa, Artificial Sequence
  Description of Artificial Sequence: Synthetic polypeptide
SDKGPLPLRDDNGIVLLGERAAKCRAYAKALHYKELEFQK

SEQ ID NO: 7327 - protein, 40 aa, Artificial Sequence
  Description of Artificial Sequence: Synthetic polypeptide
RAYAKALHYKELEFQKGPTPAILESLISINNKLQQPEAAA

SEQ ID NO: 7328 - protein, 40 aa, Artificial Sequence
  Description of Artificial Sequence: Synthetic polypeptide
AYAKALHYKELEFQKGPTPAILESLISINNKLQQPEAAAG

SEQ ID NO: 7329 - protein, 40 aa, Artificial Sequence
  Description of Artificial Sequence: Synthetic polypeptide
YAKALHYKELEFQKGPTPAILESLISINNKLQQPEAAAGV

SEQ ID NO: 7330 - protein, 40 aa, Artificial Sequence
  Description of Artificial Sequence: Synthetic polypeptide
AKALHYKELEFQKGPTPAILESLISINNKLQQPEAAAGVL

SEQ ID NO: 7331 - protein, 40 aa, Artificial Sequence
  Description of Artificial Sequence: Synthetic polypeptide
KALHYKELEFQKGPTPAILESLISINNKLQQPEAAAGVLE

SEQ ID NO: 7332 - protein, 40 aa, Artificial Sequence
  Description of Artificial Sequence: Synthetic polypeptide
ALHYKELEFQKGPTPAILESLISINNKLQQPEAAAGVLEY

SEQ ID NO: 7333 - protein, 40 aa, Artificial Sequence
  Description of Artificial Sequence: Synthetic polypeptide
DKKMDTNKDDPELMLGRMRCLEALGEWGQLHQQCCEKWTL

SEQ ID NO: 7334 - protein, 40 aa, Artificial Sequence
  Description of Artificial Sequence: Synthetic polypeptide
AMAGESYSRAYGAMVSCHMLSELEEVIQYKLVPERREIIR

SEQ ID NO: 7335 - protein, 40 aa, Artificial Sequence
  Description of Artificial Sequence: Synthetic polypeptide
QGCQRIVEDWQKILMVRSLVVSPHEDMRTWLKYASLCGKS

SEQ ID NO: 7336 - protein, 40 aa, Artificial Sequence
  Description of Artificial Sequence: Synthetic polypeptide
CQRIVEDWQKILMVRSLVVSPHEDMRTWLKYASLCGKSGR

SEQ ID NO: 7337 - protein, 40 aa, Artificial Sequence
  Description of Artificial Sequence: Synthetic polypeptide
WQKILMVRSLVVSPHEDMRTWLKYASLCGKSGRLALAHKT

SEQ ID NO: 7338 - protein, 40 aa, Artificial Sequence
  Description of Artificial Sequence: Synthetic polypeptide
SPHEDMRTWLKYASLCGKSGRLALAHKTLVLLLGVDPSRQ

SEQ ID NO: 7339 - protein, 40 aa, Artificial Sequence
  Description of Artificial Sequence: Synthetic polypeptide
SGRLALAHKTLVLLLGVDPSRQLDHPLPTVHPQVTYAYMK

SEQ ID NO: 7340 - protein, 40 aa, Artificial Sequence
  Description of Artificial Sequence: Synthetic polypeptide
RLALAHKTLVLLLGVDPSRQLDHPLPTVHPQVTYAYMKNM

SEQ ID NO: 7341 - protein, 40 aa, Artificial Sequence
  Description of Artificial Sequence: Synthetic polypeptide
WYKAWHAWAVMNFEAVLHYKHQNQARDEKKKLRHASGANI

SEQ ID NO: 7342 - protein, 40 aa, Artificial Sequence
  Description of Artificial Sequence: Synthetic polypeptide
SPLQKKVTEDLSKTLLMYTVPAVQGFFRSISLSRGNNLQD

SEQ ID NO: 7343 - protein, 40 aa, Artificial Sequence
  Description of Artificial Sequence: Synthetic polypeptide
SKTLLMYTVPAVQGFFRSISLSRGNNLQDTLRVLTLWFDY

SEQ ID NO: 7344 - protein, 40 aa, Artificial Sequence
  Description of Artificial Sequence: Synthetic polypeptide
YTVPAVQGFFRSISLSRGNNLQDTLRVLTLWFDYGHWPDV

SEQ ID NO: 7345 - protein, 40 aa, Artificial Sequence
  Description of Artificial Sequence: Synthetic polypeptide
VLTLWFDYGHWPDVNEALVEGVKAIQIDTWLQVIPQLIAR

SEQ ID NO: 7346 - protein, 40 aa, Artificial Sequence
  Description of Artificial Sequence: Synthetic polypeptide
TLWFDYGHWPDVNEALVEGVKAIQIDTWLQVIPQLIARID

SEQ ID NO: 7347 - protein, 40 aa, Artificial Sequence
  Description of Artificial Sequence: Synthetic polypeptide
GHWPDVNEALVEGVKAIQIDTWLQVIPQLIARIDTPRPLV

SEQ ID NO: 7348 - protein, 40 aa, Artificial Sequence
  Description of Artificial Sequence: Synthetic polypeptide
IARIDTPRPLVGRLIHQLLTDIGRYHPQALIYPLTVASKS

SEQ ID NO: 7349 - protein, 40 aa, Artificial Sequence
  Description of Artificial Sequence: Synthetic polypeptide
PRPLVGRLIHQLLTDIGRYHPQALIYPLTVASKSTTTARH

SEQ ID NO: 7350 - protein, 40 aa, Artificial Sequence
  Description of Artificial Sequence: Synthetic polypeptide
PLTVASKSTTTARHNAANKILKNMCEHSNTLVQQAMMVSE

SEQ ID NO: 7351 - protein, 40 aa, Artificial Sequence
  Description of Artificial Sequence: Synthetic polypeptide
SRLYFGERNVKGMFEVLEPLHAMMERGPQTLKETSFNQAY

SEQ ID NO: 7352 - protein, 40 aa, Artificial Sequence
  Description of Artificial Sequence: Synthetic polypeptide
YFGERNVKGMFEVLEPLHAMMERGPQTLKETSFNQAYGRD

SEQ ID NO: 7353 - protein, 40 aa, Artificial Sequence
  Description of Artificial Sequence: Synthetic polypeptide
EVLEPLHAMMERGPQTLKETSFNQAYGRDLMEAQEWCRKY

SEQ ID NO: 7354 - protein, 40 aa, Artificial Sequence
  Description of Artificial Sequence: Synthetic polypeptide
MKETSFNQAYGRDLMEAQEWCRKYMKSGNVKDLTQAWDLY

SEQ ID NO: 7355 - protein, 40 aa, Artificial Sequence
  Description of Artificial Sequence: Synthetic polypeptide
ETSFNQAYGRDLMEAQEWCRKYMKSGNVKDLTQAWDLYYH

SEQ ID NO: 7356 - protein, 40 aa, Artificial Sequence
  Description of Artificial Sequence: Synthetic polypeptide
MTLMQKVEVFEHAVNNTAGDDLAKLLWLKSPSSEVWFDRR

SEQ ID NO: 7357 - protein, 40 aa, Artificial Sequence
  Description of Artificial Sequence: Synthetic polypeptide
AGDDLAKLLWLKSPSSEVWFDRRTNYTRSLAVMSMVGYIL

SEQ ID NO: 7358 - protein, 40 aa, Artificial Sequence
  Description of Artificial Sequence: Synthetic polypeptide
HPSNLMLDRLSGKILHIDFGDCFEVAMTREKFPEKIPFRL

SEQ ID NO: 7359 - protein, 40 aa, Artificial Sequence
  Description of Artificial Sequence: Synthetic polypeptide
SNLMLDRLSGKILHIDFGDCFEVAMTREKFPEKIPFRLTR

SEQ ID NO: 7360 - protein, 40 aa, Artificial Sequence
  Description of Artificial Sequence: Synthetic polypeptide
KRSRTRTDSYSAGQSVEILDGVELGEPAHKKTGTTVPESI

SEQ ID NO: 7361 - protein, 40 aa, Artificial Sequence
  Description of Artificial Sequence: Synthetic polypeptide
RSRTRTDSYSAGQSVEILDGVELGEPAHKKTGTTVPESIH

SEQ ID NO: 7362 - protein, 40 aa, Artificial Sequence
  Description of Artificial Sequence: Synthetic polypeptide
YSAGQSVEILDGVELGEPAHKKTGTTVPESIHSFIGDGLV

SEQ ID NO: 7363 - protein, 40 aa, Artificial Sequence
  Description of Artificial Sequence: Synthetic polypeptide
SAGQSVEILDGVELGEPAHKKTGTTVPESIHSFIGDGLVK

SEQ ID NO: 7364 - protein, 40 aa, Artificial Sequence
  Description of Artificial Sequence: Synthetic polypeptide
AGQSVEILDGVELGEPAHKKTGTTVPESIHSFIGDGLVKP

SEQ ID NO: 7365 - protein, 40 aa, Artificial Sequence
  Description of Artificial Sequence: Synthetic polypeptide
VEILDGVELGEPAHKKTGTTVPESIHSFIGDGLVKPEALN

SEQ ID NO: 7366 - protein, 40 aa, Artificial Sequence
  Description of Artificial Sequence: Synthetic polypeptide
EILDGVELGEPAHKKTGTTVPESIHSFIGDGLVKPEALNK

SEQ ID NO: 7367 - protein, 40 aa, Artificial Sequence
  Description of Artificial Sequence: Synthetic polypeptide
ILDGVELGEPAHKKTGTTVPESIHSFIGDGLVKPEALNKK

SEQ ID NO: 7368 - protein, 40 aa, Artificial Sequence
  Description of Artificial Sequence: Synthetic polypeptide
MDGVELGEPAHKKTGTTVPESIHSFIGDGLVKPEALNKKA

SEQ ID NO: 7369 - protein, 40 aa, Artificial Sequence
  Description of Artificial Sequence: Synthetic polypeptide
DGVELGEPAHKKTGTTVPESIHSFIGDGLVKPEALNKKAI

SEQ ID NO: 7370 - protein, 40 aa, Artificial Sequence
  Description of Artificial Sequence: Synthetic polypeptide
VELGEPAHKKTGTTVPESIHSFIGDGLVKPEALNKKAIQI

SEQ ID NO: 7371 - protein, 40 aa, Artificial Sequence
  Description of Artificial Sequence: Synthetic polypeptide
AHKKTGTTVPESIHSFIGDGLVKPEALNKKAIQIINRVRD

SEQ ID NO: 7372 - protein, 40 aa, Artificial Sequence
  Description of Artificial Sequence: Synthetic polypeptide
KKTGTTVPESIHSFIGDGLVKPEALNKKAIQIINRVRDKL

SEQ ID NO: 7373 - protein, 40 aa, Artificial Sequence
  Description of Artificial Sequence: Synthetic polypeptide
TGTTVPESIHSFIGDGLVKPEALNKKAIQIINRVRDKLTG

SEQ ID NO: 7374 - protein, 40 aa, Artificial Sequence
  Description of Artificial Sequence: Synthetic polypeptide
TVPESIHSFIGDGLVKPEALNKKAIQIINRVRDKLTGRDF

SEQ ID NO: 7375 - protein, 40 aa, Artificial Sequence
  Description of Artificial Sequence: Synthetic polypeptide
VPESIHSFIGDGLVKPEALNKKAIQIINRVRDKLTGRDFS

SEQ ID NO: 7376 - protein, 40 aa, Artificial Sequence
  Description of Artificial Sequence: Synthetic polypeptide
PESIHSFIGDGLVKPEALNKKAIQIINRVRDKLTGRDFSH

SEQ ID NO: 7377 - protein, 40 aa, Artificial Sequence
  Description of Artificial Sequence: Synthetic polypeptide
ESIHSFIGDGLVKPEALNKKAIQIINRVRDKLTGRDFSHD

SEQ ID NO: 7378 - protein, 40 aa, Artificial Sequence
  Description of Artificial Sequence: Synthetic polypeptide
MVKPEALNKKAIQIINRVRDKLTGRDFSHDDTLDVPTQVE

SEQ ID NO: 7379 - protein, 40 aa, Artificial Sequence
  Description of Artificial Sequence: Synthetic polypeptide
KPEALNKKAIQIINRVRDKLTGRDFSHDDTLDVPTQVELL

SEQ ID NO: 7380 - protein, 40 aa, Artificial Sequence
  Description of Artificial Sequence: Synthetic polypeptide
QQPPATMPLNVSFTNRNYDLDYDSVQPYFYCDEEENFYQQ

SEQ ID NO: 7381 - protein, 40 aa, Artificial Sequence
  Description of Artificial Sequence: Synthetic polypeptide
LNVSFTNRNYDLDYDSVQPYFYCDEEENFYQQQQQSELQP

SEQ ID NO: 7382 - protein, 40 aa, Artificial Sequence
  Description of Artificial Sequence: Synthetic polypeptide
NYDLDYDSVQPYFYCDEEENFYQQQQQSELQPPAPSEDIW

SEQ ID NO: 7383 - protein, 40 aa, Artificial Sequence
  Description of Artificial Sequence: Synthetic polypeptide
DSVQPYFYCDEEENFYQQQQQSELQPPAPSEDIWKKFELL

SEQ ID NO: 7384 - protein, 40 aa, Artificial Sequence
  Description of Artificial Sequence: Synthetic polypeptide
THNVLERQRRNELKRSFFALRDQIPELENNEKAPKVVILK

SEQ ID NO: 7385 - protein, 40 aa, Artificial Sequence
  Description of Artificial Sequence: Synthetic polypeptide
HNVLERQRRNELKRSFFALRDQIPELENNEKAPKVVILKK

SEQ ID NO: 7386 - protein, 40 aa, Artificial Sequence
  Description of Artificial Sequence: Synthetic polypeptide
NVLERQRRNELKRSFFALRDQIPELENNEKAPKVVILKKA

SEQ ID NO: 7387 - protein, 40 aa, Artificial Sequence
  Description of Artificial Sequence: Synthetic polypeptide
ERQRRNELKRSFFALRDQIPELENNEKAPKVVILKKATAY

SEQ ID NO: 7388 - protein, 40 aa, Artificial Sequence
  Description of Artificial Sequence: Synthetic polypeptide
RQRRNELKRSFFALRDQIPELENNEKAPKVVILKKATAYI

SEQ ID NO: 7389 - protein, 40 aa, Artificial Sequence
  Description of Artificial Sequence: Synthetic polypeptide
RRNELKRSFFALRDQIPELENNEKAPKVVILKKATAYILS

SEQ ID NO: 7390 - protein, 40 aa, Artificial Sequence
  Description of Artificial Sequence: Synthetic polypeptide
RNELKRSFFALRDQIPELENNEKAPKVVILKKATAYILSV

SEQ ID NO: 7391 - protein, 40 aa, Artificial Sequence
  Description of Artificial Sequence: Synthetic polypeptide
NELKRSFFALRDQIPELENNEKAPKVVILKKATAYILSVQ

SEQ ID NO: 7392 - protein, 40 aa, Artificial Sequence
  Description of Artificial Sequence: Synthetic polypeptide
ELKRSFFALRDQIPELENNEKAPKVVILKKATAYILSVQA

SEQ ID NO: 7393 - protein, 40 aa, Artificial Sequence
  Description of Artificial Sequence: Synthetic polypeptide
KRSFFALRDQIPELENNEKAPKVVILKKATAYILSVQAEE

SEQ ID NO: 7394 - protein, 40 aa, Artificial Sequence
  Description of Artificial Sequence: Synthetic polypeptide
RSFFALRDQIPELENNEKAPKVVILKKATAYILSVQAEEQ

SEQ ID NO: 7395 - protein, 40 aa, Artificial Sequence
  Description of Artificial Sequence: Synthetic polypeptide
SFFALRDQIPELENNEKAPKVVILKKATAYILSVQAEEQK

SEQ ID NO: 7396 - protein, 40 aa, Artificial Sequence
  Description of Artificial Sequence: Synthetic polypeptide
FFALRDQIPELENNEKAPKVVILKKATAYILSVQAEEQKL

SEQ ID NO: 7397 - protein, 40 aa, Artificial Sequence
  Description of Artificial Sequence: Synthetic polypeptide
FALRDQIPELENNEKAPKVVILKKATAYILSVQAEEQKLI

SEQ ID NO: 7398 - protein, 40 aa, Artificial Sequence
  Description of Artificial Sequence: Synthetic polypeptide
ALRDQIPELENNEKAPKVVILKKATAYILSVQAEEQKLIS

SEQ ID NO: 7399 - protein, 40 aa, Artificial Sequence
  Description of Artificial Sequence: Synthetic polypeptide
MRDQIPELENNEKAPKVVILKKATAYILSVQAEEQKLISE

SEQ ID NO: 7400 - protein, 40 aa, Artificial Sequence
  Description of Artificial Sequence: Synthetic polypeptide
RDQIPELENNEKAPKVVILKKATAYILSVQAEEQKLISEE

SEQ ID NO: 7401 - protein, 40 aa, Artificial Sequence
  Description of Artificial Sequence: Synthetic polypeptide
DQIPELENNEKAPKVVILKKATAYILSVQAEEQKLISEED

SEQ ID NO: 7402 - protein, 40 aa, Artificial Sequence
  Description of Artificial Sequence: Synthetic polypeptide
QIPELENNEKAPKVVILKKATAYILSVQAEEQKLISEEDL

SEQ ID NO: 7403 - protein, 40 aa, Artificial Sequence
  Description of Artificial Sequence: Synthetic polypeptide
IPELENNEKAPKVVILKKATAYILSVQAEEQKLISEEDLL

SEQ ID NO: 7404 - protein, 40 aa, Artificial Sequence
  Description of Artificial Sequence: Synthetic polypeptide
PELENNEKAPKVVILKKATAYILSVQAEEQKLISEEDLLR

SEQ ID NO: 7405 - protein, 40 aa, Artificial Sequence
  Description of Artificial Sequence: Synthetic polypeptide
ELENNEKAPKVVILKKATAYILSVQAEEQKLISEEDLLRK

SEQ ID NO: 7406 - protein, 40 aa, Artificial Sequence
  Description of Artificial Sequence: Synthetic polypeptide
NNEKAPKVVILKKATAYILSVQAEEQKLISEEDLLRKRRE

SEQ ID NO: 7407 - protein, 40 aa, Artificial Sequence
  Description of Artificial Sequence: Synthetic polypeptide
EKAPKVVILKKATAYILSVQAEEQKLISEEDLLRKRREQL

SEQ ID NO: 7408 - protein, 40 aa, Artificial Sequence
  Description of Artificial Sequence: Synthetic polypeptide
KAPKVVILKKATAYILSVQAEEQKLISEEDLLRKRREQLK

SEQ ID NO: 7409 - protein, 40 aa, Artificial Sequence
  Description of Artificial Sequence: Synthetic polypeptide
VILKKATAYILSVQAEEQKLISEEDLLRKRREQLKHKLEQ

SEQ ID NO: 7410 - protein, 40 aa, Artificial Sequence
  Description of Artificial Sequence: Synthetic polypeptide
TAPSEDIWKKFELVPSPPTSPPWGLGPGAGDPAPGIGPPE

SEQ ID NO: 7411 - protein, 40 aa, Artificial Sequence
  Description of Artificial Sequence: Synthetic polypeptide
EDIWKKFELVPSPPTSPPWGLGPGAGDPAPGIGPPEPWPG

SEQ ID NO: 7412 - protein, 40 aa, Artificial Sequence
  Description of Artificial Sequence: Synthetic polypeptide
DIWKKFELVPSPPTSPPWGLGPGAGDPAPGIGPPEPWPGG

SEQ ID NO: 7413 - protein, 40 aa, Artificial Sequence
  Description of Artificial Sequence: Synthetic polypeptide
IWKKFELVPSPPTSPPWGLGPGAGDPAPGIGPPEPWPGGC

SEQ ID NO: 7414 - protein, 40 aa, Artificial Sequence
  Description of Artificial Sequence: Synthetic polypeptide
WKKFELVPSPPTSPPWGLGPGAGDPAPGIGPPEPWPGGCT

SEQ ID NO: 7415 - protein, 40 aa, Artificial Sequence
  Description of Artificial Sequence: Synthetic polypeptide
KKFELVPSPPTSPPWGLGPGAGDPAPGIGPPEPWPGGCTG

SEQ ID NO: 7416 - protein, 40 aa, Artificial Sequence
  Description of Artificial Sequence: Synthetic polypeptide
KFELVPSPPTSPPWGLGPGAGDPAPGIGPPEPWPGGCTGD

SEQ ID NO: 7417 - protein, 40 aa, Artificial Sequence
  Description of Artificial Sequence: Synthetic polypeptide
PPTSPPWGLGPGAGDPAPGIGPPEPWPGGCTGDEAESRGH

SEQ ID NO: 7418 - protein, 40 aa, Artificial Sequence
  Description of Artificial Sequence: Synthetic polypeptide
TSPPWGLGPGAGDPAPGIGPPEPWPGGCTGDEAESRGHSK

SEQ ID NO: 7419 - protein, 40 aa, Artificial Sequence
  Description of Artificial Sequence: Synthetic polypeptide
IRRDCMWSGFSARERLERAVSDRLAPGAPRGNPPKASAAP

SEQ ID NO: 7420 - protein, 40 aa, Artificial Sequence
  Description of Artificial Sequence: Synthetic polypeptide
CSGSESPSDSENEEIDVVTVEKRQSLGIRKPVTITVRADP

SEQ ID NO: 7421 - protein, 40 aa, Artificial Sequence
  Description of Artificial Sequence: Synthetic polypeptide
VVTVEKRQSLGIRKPVTITVRADPLDPCMKHFHISIHQQQ

SEQ ID NO: 7422 - protein, 40 aa, Artificial Sequence
  Description of Artificial Sequence: Synthetic polypeptide
QEEASERGPQEEVLERDAAGEKEDEEDEEIVSPPPVESEA

SEQ ID NO: 7423 - protein, 40 aa, Artificial Sequence
  Description of Artificial Sequence: Synthetic polypeptide
DTEDVTKRKNHNFLERKRRNDLRSRFLALRDQVPTLASCS

SEQ ID NO: 7424 - protein, 40 aa, Artificial Sequence
  Description of Artificial Sequence: Synthetic polypeptide
HNFLERKRRNDLRSRFLALRDQVPTLASCSKAPKVVILSK

SEQ ID NO: 7425 - protein, 40 aa, Artificial Sequence
  Description of Artificial Sequence: Synthetic polypeptide
RRNDLRSRFLALRDQVPTLASCSKAPKVVILSKALEYLQA

SEQ ID NO: 7426 - protein, 40 aa, Artificial Sequence
  Description of Artificial Sequence: Synthetic polypeptide
SKALEYLQALVGAEKRMATEKRQLRCRQQQLQKRIAYLTG

SEQ ID NO: 7427 - protein, 40 aa, Artificial Sequence
  Description of Artificial Sequence: Synthetic polypeptide
GLGGLGGLTPNPVILQDCMWSGFSAREKLERAVSEKLQHG

SEQ ID NO: 7428 - protein, 40 aa, Artificial Sequence
  Description of Artificial Sequence: Synthetic polypeptide
QDCMWSGFSAREKLERAVSEKLQHGRGPPTAGSTAQSPGA

SEQ ID NO: 7429 - protein, 40 aa, Artificial Sequence
  Description of Artificial Sequence: Synthetic polypeptide
AAECVDPAVVFPFPVNKREPAPVPAAPASAPAAGPAVASG

SEQ ID NO: 7430 - protein, 40 aa, Artificial Sequence
  Description of Artificial Sequence: Synthetic polypeptide
ECVDPAVVFPFPVNKREPAPVPAAPASAPAAGPAVASGAG

SEQ ID NO: 7431 - protein, 40 aa, Artificial Sequence
  Description of Artificial Sequence: Synthetic polypeptide
CVDPAVVFPFPVNKREPAPVPAAPASAPAAGPAVASGAGI

SEQ ID NO: 7432 - protein, 40 aa, Artificial Sequence
  Description of Artificial Sequence: Synthetic polypeptide
VDPAVVFPFPVNKREPAPVPAAPASAPAAGPAVASGAGIA

SEQ ID NO: 7433 - protein, 40 aa, Artificial Sequence
  Description of Artificial Sequence: Synthetic polypeptide
AVVFPFPVNKREPAPVPAAPASAPAAGPAVASGAGIAAPA

SEQ ID NO: 7434 - protein, 40 aa, Artificial Sequence
  Description of Artificial Sequence: Synthetic polypeptide
VFPFPVNKREPAPVPAAPASAPAAGPAVASGAGIAAPAGA

SEQ ID NO: 7435 - protein, 40 aa, Artificial Sequence
  Description of Artificial Sequence: Synthetic polypeptide
FPFPVNKREPAPVPAAPASAPAAGPAVASGAGIAAPAGAP

SEQ ID NO: 7436 - protein, 40 aa, Artificial Sequence
  Description of Artificial Sequence: Synthetic polypeptide
REPAPVPAAPASAPAAGPAVASGAGIAAPAGAPGVAPPRP

SEQ ID NO: 7437 - protein, 40 aa, Artificial Sequence
  Description of Artificial Sequence: Synthetic polypeptide
PAAGPAVASGAGIAAPAGAPGVAPPRPGGRQTSGGDHKAL

SEQ ID NO: 7438 - protein, 40 aa, Artificial Sequence
  Description of Artificial Sequence: Synthetic polypeptide
GPAVASGAGIAAPAGAPGVAPPRPGGRQTSGGDHKALSTS

SEQ ID NO: 7439 - protein, 40 aa, Artificial Sequence
  Description of Artificial Sequence: Synthetic polypeptide
AVASGAGIAAPAGAPGVAPPRPGGRQTSGGDHKALSTSGE

SEQ ID NO: 7440 - protein, 40 aa, Artificial Sequence
  Description of Artificial Sequence: Synthetic polypeptide
SGAGIAAPAGAPGVAPPRPGGRQTSGGDHKALSTSGEDTL

SEQ ID NO: 7441 - protein, 40 aa, Artificial Sequence
  Description of Artificial Sequence: Synthetic polypeptide
AGIAAPAGAPGVAPPRPGGRQTSGGDHKALSTSGEDTLSD

SEQ ID NO: 7442 - protein, 40 aa, Artificial Sequence
  Description of Artificial Sequence: Synthetic polypeptide
IAAPAGAPGVAPPRPGGRQTSGGDHKALSTSGEDTLSDSD

SEQ ID NO: 7443 - protein, 40 aa, Artificial Sequence
  Description of Artificial Sequence: Synthetic polypeptide
PPQKKIKSEASPRPLKSVIPPKAKSLSPRNSDSEDSERRR

SEQ ID NO: 7444 - protein, 40 aa, Artificial Sequence
  Description of Artificial Sequence: Synthetic polypeptide
KIKSEASPRPLKSVIPPKAKSLSPRNSDSEDSERRRNHNI

SEQ ID NO: 7445 - protein, 40 aa, Artificial Sequence
  Description of Artificial Sequence: Synthetic polypeptide
SPRPLKSVIPPKAKSLSPRNSDSEDSERRRNHNILERQRR

SEQ ID NO: 7446 - protein, 40 aa, Artificial Sequence
  Description of Artificial Sequence: Synthetic polypeptide
RPLKSVIPPKAKSLSPRNSDSEDSERRRNHNILERQRRND

SEQ ID NO: 7447 - protein, 40 aa, Artificial Sequence
  Description of Artificial Sequence: Synthetic polypeptide
PLKSVIPPKAKSLSPRNSDSEDSERRRNHNILERQRRNDL

SEQ ID NO: 7448 - protein, 40 aa, Artificial Sequence
  Description of Artificial Sequence: Synthetic polypeptide
LKSVIPPKAKSLSPRNSDSEDSERRRNHNILERQRRNDLR

SEQ ID NO: 7449 - protein, 40 aa, Artificial Sequence
  Description of Artificial Sequence: Synthetic polypeptide
VIPPKAKSLSPRNSDSEDSERRRNHNILERQRRNDLRSSF

SEQ ID NO: 7450 - protein, 40 aa, Artificial Sequence
  Description of Artificial Sequence: Synthetic polypeptide
KAKSLSPRNSDSEDSERRRNHNILERQRRNDLRSSFLTLR

SEQ ID NO: 7451 - protein, 40 aa, Artificial Sequence
  Description of Artificial Sequence: Synthetic polypeptide
ERQRRNDLRSSFLTLRDHVPELVKNEKAAKVVILKKATEY

SEQ ID NO: 7452 - protein, 40 aa, Artificial Sequence
  Description of Artificial Sequence: Synthetic polypeptide
VPELVKNEKAAKVVILKKATEYVHSLQAEEHQLLLEKEKL

SEQ ID NO: 7453 - protein, 40 aa, Artificial Sequence
  Description of Artificial Sequence: Synthetic polypeptide
MKKATEYVHSLQAEEHQLLLEKEKLQARQQQLLKKIEHAR

SEQ ID NO: 7454 - protein, 40 aa, Artificial Sequence
  Description of Artificial Sequence: Synthetic polypeptide
RKRKLPCDTPGQGLTCSGEKRRREQESKYIEELAELISAN

SEQ ID NO: 7455 - protein, 40 aa, Artificial Sequence
  Description of Artificial Sequence: Synthetic polypeptide
LTCSGEKRRREQESKYIEELAELISANLSDIDNFNVKPDK

SEQ ID NO: 7456 - protein, 40 aa, Artificial Sequence
  Description of Artificial Sequence: Synthetic polypeptide
EKRRREQESKYIEELAELISANLSDIDNFNVKPDKCAILK

SEQ ID NO: 7457 - protein, 40 aa, Artificial Sequence
  Description of Artificial Sequence: Synthetic polypeptide
RRREQESKYIEELAELISANLSDIDNFNVKPDKCAILKET

SEQ ID NO: 7458 - protein, 40 aa, Artificial Sequence
  Description of Artificial Sequence: Synthetic polypeptide
YIEELAELISANLSDIDNFNVKPDKCAILKETVRQIRQIK

SEQ ID NO: 7459 - protein, 40 aa, Artificial Sequence
  Description of Artificial Sequence: Synthetic polypeptide
ELAELISANLSDIDNFNVKPDKCAILKETVRQIRQIKEQG

SEQ ID NO: 7460 - protein, 40 aa, Artificial Sequence
  Description of Artificial Sequence: Synthetic polypeptide
MAELISANLSDIDNFNVKPDKCAILKETVRQIRQIKEQGK

SEQ ID NO: 7461 - protein, 40 aa, Artificial Sequence
  Description of Artificial Sequence: Synthetic polypeptide
ANLSDIDNFNVKPDKCAILKETVRQIRQIKEQGKTISNDD

SEQ ID NO: 7462 - protein, 40 aa, Artificial Sequence
  Description of Artificial Sequence: Synthetic polypeptide
NLSDIDNFNVKPDKCAILKETVRQIRQIKEQGKTISNDDD

SEQ ID NO: 7463 - protein, 40 aa, Artificial Sequence
  Description of Artificial Sequence: Synthetic polypeptide
LSDIDNFNVKPDKCAILKETVRQIRQIKEQGKTISNDDDV

SEQ ID NO: 7464 - protein, 40 aa, Artificial Sequence
  Description of Artificial Sequence: Synthetic polypeptide
SDIDNFNVKPDKCAILKETVRQIRQIKEQGKTISNDDDVQ

SEQ ID NO: 7465 - protein, 40 aa, Artificial Sequence
  Description of Artificial Sequence: Synthetic polypeptide
DIDNFNVKPDKCAILKETVRQIRQIKEQGKTISNDDDVQK

SEQ ID NO: 7466 - protein, 40 aa, Artificial Sequence
  Description of Artificial Sequence: Synthetic polypeptide
IDNFNVKPDKCAILKETVRQIRQIKEQGKTISNDDDVQKA

SEQ ID NO: 7467 - protein, 40 aa, Artificial Sequence
  Description of Artificial Sequence: Synthetic polypeptide
DNFNVKPDKCAILKETVRQIRQIKEQGKTISNDDDVQKAD

SEQ ID NO: 7468 - protein, 40 aa, Artificial Sequence
  Description of Artificial Sequence: Synthetic polypeptide
FNVKPDKCAILKETVRQIRQIKEQGKTISNDDDVQKADVS

SEQ ID NO: 7469 - protein, 40 aa, Artificial Sequence
  Description of Artificial Sequence: Synthetic polypeptide
NVKPDKCAILKETVRQIRQIKEQGKTISNDDDVQKADVSS

SEQ ID NO: 7470 - protein, 40 aa, Artificial Sequence
  Description of Artificial Sequence: Synthetic polypeptide
VKPDKCAILKETVRQIRQIKEQGKTISNDDDVQKADVSST

SEQ ID NO: 7471 - protein, 40 aa, Artificial Sequence
  Description of Artificial Sequence: Synthetic polypeptide
PDKCAILKETVRQIRQIKEQGKTISNDDDVQKADVSSTGQ

SEQ ID NO: 7472 - protein, 40 aa, Artificial Sequence
  Description of Artificial Sequence: Synthetic polypeptide
DKCAILKETVRQIRQIKEQGKTISNDDDVQKADVSSTGQG

SEQ ID NO: 7473 - protein, 40 aa, Artificial Sequence
  Description of Artificial Sequence: Synthetic polypeptide
KCAILKETVRQIRQIKEQGKTISNDDDVQKADVSSTGQGV

SEQ ID NO: 7474 - protein, 40 aa, Artificial Sequence
  Description of Artificial Sequence: Synthetic polypeptide
CAILKETVRQIRQIKEQGKTISNDDDVQKADVSSTGQGVI

SEQ ID NO: 7475 - protein, 40 aa, Artificial Sequence
  Description of Artificial Sequence: Synthetic polypeptide
AILKETVRQIRQIKEQGKTISNDDDVQKADVSSTGQGVID

SEQ ID NO: 7476 - protein, 40 aa, Artificial Sequence
  Description of Artificial Sequence: Synthetic polypeptide
LKETVRQIRQIKEQGKTISNDDDVQKADVSSTGQGVIDKD

SEQ ID NO: 7477 - protein, 40 aa, Artificial Sequence
  Description of Artificial Sequence: Synthetic polypeptide
KETVRQIRQIKEQGKTISNDDDVQKADVSSTGQGVIDKDS

SEQ ID NO: 7478 - protein, 40 aa, Artificial Sequence
  Description of Artificial Sequence: Synthetic polypeptide
ETVRQIRQIKEQGKTISNDDDVQKADVSSTGQGVIDKDSL

SEQ ID NO: 7479 - protein, 40 aa, Artificial Sequence
  Description of Artificial Sequence: Synthetic polypeptide
TVRQIRQIKEQGKTISNDDDVQKADVSSTGQGVIDKDSLG

SEQ ID NO: 7480 - protein, 40 aa, Artificial Sequence
  Description of Artificial Sequence: Synthetic polypeptide
VRQIRQIKEQGKTISNDDDVQKADVSSTGQGVIDKDSLGP

SEQ ID NO: 7481 - protein, 40 aa, Artificial Sequence
  Description of Artificial Sequence: Synthetic polypeptide
IRQIKEQGKTISNDDDVQKADVSSTGQGVIDKDSLGPLLL

SEQ ID NO: 7482 - protein, 40 aa, Artificial Sequence
  Description of Artificial Sequence: Synthetic polypeptide
QIKEQGKTISNDDDVQKADVSSTGQGVIDKDSLGPLLLQA

SEQ ID NO: 7483 - protein, 40 aa, Artificial Sequence
  Description of Artificial Sequence: Synthetic polypeptide
GKTISNDDDVQKADVSSTGQGVIDKDSLGPLLLQALDGFL

SEQ ID NO: 7484 - protein, 40 aa, Artificial Sequence
  Description of Artificial Sequence: Synthetic polypeptide
KTISNDDDVQKADVSSTGQGVIDKDSLGPLLLQALDGFLF

SEQ ID NO: 7485 - protein, 40 aa, Artificial Sequence
  Description of Artificial Sequence: Synthetic polypeptide
TISNDDDVQKADVSSTGQGVIDKDSLGPLLLQALDGFLFV

SEQ ID NO: 7486 - protein, 40 aa, Artificial Sequence
  Description of Artificial Sequence: Synthetic polypeptide
ISNDDDVQKADVSSTGQGVIDKDSLGPLLLQALDGFLFVV

SEQ ID NO: 7487 - protein, 40 aa, Artificial Sequence
  Description of Artificial Sequence: Synthetic polypeptide
SNDDDVQKADVSSTGQGVIDKDSLGPLLLQALDGFLFVVN

SEQ ID NO: 7488 - protein, 40 aa, Artificial Sequence
  Description of Artificial Sequence: Synthetic polypeptide
NDDDVQKADVSSTGQGVIDKDSLGPLLLQALDGFLFVVNR

SEQ ID NO: 7489 - protein, 40 aa, Artificial Sequence
  Description of Artificial Sequence: Synthetic polypeptide
VQKADVSSTGQGVIDKDSLGPLLLQALDGFLFVVNRDGNI

SEQ ID NO: 7490 - protein, 40 aa, Artificial Sequence
  Description of Artificial Sequence: Synthetic polypeptide
ADVSSTGQGVIDKDSLGPLLLQALDGFLFVVNRDGNIVFV

SEQ ID NO: 7491 - protein, 40 aa, Artificial Sequence
  Description of Artificial Sequence: Synthetic polypeptide
DVSSTGQGVIDKDSLGPLLLQALDGFLFVVNRDGNIVFVS

SEQ ID NO: 7492 - protein, 40 aa, Artificial Sequence
  Description of Artificial Sequence: Synthetic polypeptide
SSTGQGVIDKDSLGPLLLQALDGFLFVVNRDGNIVFVSEN

SEQ ID NO: 7493 - protein, 40 aa, Artificial Sequence
  Description of Artificial Sequence: Synthetic polypeptide
IDKDSLGPLLLQALDGFLFVVNRDGNIVFVSENVTQYLQY

SEQ ID NO: 7494 - protein, 40 aa, Artificial Sequence
  Description of Artificial Sequence: Synthetic polypeptide
DKDSLGPLLLQALDGFLFVVNRDGNIVFVSENVTQYLQYK

SEQ ID NO: 7495 - protein, 40 aa, Artificial Sequence
  Description of Artificial Sequence: Synthetic polypeptide
KDSLGPLLLQALDGFLFVVNRDGNIVFVSENVTQYLQYKQ

SEQ ID NO: 7496 - protein, 40 aa, Artificial Sequence
  Description of Artificial Sequence: Synthetic polypeptide
LGPLLLQALDGFLFVVNRDGNIVFVSENVTQYLQYKQEDL

SEQ ID NO: 7497 - protein, 40 aa, Artificial Sequence
  Description of Artificial Sequence: Synthetic polypeptide
GPLLLQALDGFLFVVNRDGNIVFVSENVTQYLQYKQEDLV

SEQ ID NO: 7498 - protein, 40 aa, Artificial Sequence
  Description of Artificial Sequence: Synthetic polypeptide
PLLLQALDGFLFVVNRDGNIVFVSENVTQYLQYKQEDLVN

SEQ ID NO: 7499 - protein, 40 aa, Artificial Sequence
  Description of Artificial Sequence: Synthetic polypeptide
LLLQALDGFLFVVNRDGNIVFVSENVTQYLQYKQEDLVNT

SEQ ID NO: 7500 - protein, 40 aa, Artificial Sequence
  Description of Artificial Sequence: Synthetic polypeptide
QALDGFLFVVNRDGNIVFVSENVTQYLQYKQEDLVNTSVY

SEQ ID NO: 7501 - protein, 40 aa, Artificial Sequence
  Description of Artificial Sequence: Synthetic polypeptide
MDGFLFVVNRDGNIVFVSENVTQYLQYKQEDLVNTSVYNI

SEQ ID NO: 7502 - protein, 40 aa, Artificial Sequence
  Description of Artificial Sequence: Synthetic polypeptide
GFLFVVNRDGNIVFVSENVTQYLQYKQEDLVNTSVYNILH

SEQ ID NO: 7503 - protein, 40 aa, Artificial Sequence
  Description of Artificial Sequence: Synthetic polypeptide
NIVFVSENVTQYLQYKQEDLVNTSVYNILHEEDRKDFLKN

SEQ ID NO: 7504 - protein, 40 aa, Artificial Sequence
  Description of Artificial Sequence: Synthetic polypeptide
VFVSENVTQYLQYKQEDLVNTSVYNILHEEDRKDFLKNLP

SEQ ID NO: 7505 - protein, 40 aa, Artificial Sequence
  Description of Artificial Sequence: Synthetic polypeptide
FVSENVTQYLQYKQEDLVNTSVYNILHEEDRKDFLKNLPK

SEQ ID NO: 7506 - protein, 40 aa, Artificial Sequence
  Description of Artificial Sequence: Synthetic polypeptide
SENVTQYLQYKQEDLVNTSVYNILHEEDRKDFLKNLPKST

SEQ ID NO: 7507 - protein, 40 aa, Artificial Sequence
  Description of Artificial Sequence: Synthetic polypeptide
ENVTQYLQYKQEDLVNTSVYNILHEEDRKDFLKNLPKSTV

SEQ ID NO: 7508 - protein, 40 aa, Artificial Sequence
  Description of Artificial Sequence: Synthetic polypeptide
NVTQYLQYKQEDLVNTSVYNILHEEDRKDFLKNLPKSTVN

SEQ ID NO: 7509 - protein, 40 aa, Artificial Sequence
  Description of Artificial Sequence: Synthetic polypeptide
YLQYKQEDLVNTSVYNILHEEDRKDFLKNLPKSTVNGVSW

SEQ ID NO: 7510 - protein, 40 aa, Artificial Sequence
  Description of Artificial Sequence: Synthetic polypeptide
QYKQEDLVNTSVYNILHEEDRKDFLKNLPKSTVNGVSWTN

SEQ ID NO: 7511 - protein, 40 aa, Artificial Sequence
  Description of Artificial Sequence: Synthetic polypeptide
YKQEDLVNTSVYNILHEEDRKDFLKNLPKSTVNGVSWTNE

SEQ ID NO: 7512 - protein, 40 aa, Artificial Sequence
  Description of Artificial Sequence: Synthetic polypeptide
KQEDLVNTSVYNILHEEDRKDFLKNLPKSTVNGVSWTNET

SEQ ID NO: 7513 - protein, 40 aa, Artificial Sequence
  Description of Artificial Sequence: Synthetic polypeptide
QEDLVNTSVYNILHEEDRKDFLKNLPKSTVNGVSWTNETQ

SEQ ID NO: 7514 - protein, 40 aa, Artificial Sequence
  Description of Artificial Sequence: Synthetic polypeptide
EDLVNTSVYNILHEEDRKDFLKNLPKSTVNGVSWTNETQR

SEQ ID NO: 7515 - protein, 40 aa, Artificial Sequence
  Description of Artificial Sequence: Synthetic polypeptide
DLVNTSVYNILHEEDRKDFLKNLPKSTVNGVSWTNETQRQ

SEQ ID NO: 7516 - protein, 40 aa, Artificial Sequence
  Description of Artificial Sequence: Synthetic polypeptide
NTSVYNILHEEDRKDFLKNLPKSTVNGVSWTNETQRQKSH

SEQ ID NO: 7517 - protein, 40 aa, Artificial Sequence
  Description of Artificial Sequence: Synthetic polypeptide
EDRKDFLKNLPKSTVNGVSWTNETQRQKSHTFNCRMLMKT

SEQ ID NO: 7518 - protein, 40 aa, Artificial Sequence
  Description of Artificial Sequence: Synthetic polypeptide
RKDFLKNLPKSTVNGVSWTNETQRQKSHTFNCRMLMKTPH

SEQ ID NO: 7519 - protein, 40 aa, Artificial Sequence
  Description of Artificial Sequence: Synthetic polypeptide
KDFLKNLPKSTVNGVSWTNETQRQKSHTFNCRMLMKTPHD

SEQ ID NO: 7520 - protein, 40 aa, Artificial Sequence
  Description of Artificial Sequence: Synthetic polypeptide
LKNLPKSTVNGVSWTNETQRQKSHTFNCRMLMKTPHDILE

SEQ ID NO: 7521 - protein, 40 aa, Artificial Sequence
  Description of Artificial Sequence: Synthetic polypeptide
PKSTVNGVSWTNETQRQKSHTFNCRMLMKTPHDILEDINA

SEQ ID NO: 7522 - protein, 40 aa, Artificial Sequence
  Description of Artificial Sequence: Synthetic polypeptide
KSTVNGVSWTNETQRQKSHTFNCRMLMKTPHDILEDINAS

SEQ ID NO: 7523 - protein, 40 aa, Artificial Sequence
  Description of Artificial Sequence: Synthetic polypeptide
VNGVSWTNETQRQKSHTFNCRMLMKTPHDILEDINASPEM

SEQ ID NO: 7524 - protein, 40 aa, Artificial Sequence
  Description of Artificial Sequence: Synthetic polypeptide
NGVSWTNETQRQKSHTFNCRMLMKTPHDILEDINASPEMR

SEQ ID NO: 7525 - protein, 40 aa, Artificial Sequence
  Description of Artificial Sequence: Synthetic polypeptide
TNETQRQKSHTFNCRMLMKTPHDILEDINASPEMRQRYET

SEQ ID NO: 7526 - protein, 40 aa, Artificial Sequence
  Description of Artificial Sequence: Synthetic polypeptide
NETQRQKSHTFNCRMLMKTPHDILEDINASPEMRQRYETM

SEQ ID NO: 7527 - protein, 40 aa, Artificial Sequence
  Description of Artificial Sequence: Synthetic polypeptide
HTFNCRMLMKTPHDILEDINASPEMRQRYETMQCFALSQP

SEQ ID NO: 7528 - protein, 40 aa, Artificial Sequence
  Description of Artificial Sequence: Synthetic polypeptide
SCMICVARRITTGERTFPSNPESFITRHDLSGKVVNIDTN

SEQ ID NO: 7529 - protein, 40 aa, Artificial Sequence
  Description of Artificial Sequence: Synthetic polypeptide
MICVARRITTGERTFPSNPESFITRHDLSGKVVNIDTNSL

SEQ ID NO: 7530 - protein, 40 aa, Artificial Sequence
  Description of Artificial Sequence: Synthetic polypeptide
RTFPSNPESFITRHDLSGKVVNIDTNSLRSSMRPGFEDII

SEQ ID NO: 7531 - protein, 40 aa, Artificial Sequence
  Description of Artificial Sequence: Synthetic polypeptide
FPSNPESFITRHDLSGKVVNIDTNSLRSSMRPGFEDIIRR

SEQ ID NO: 7532 - protein, 40 aa, Artificial Sequence
  Description of Artificial Sequence: Synthetic polypeptide
SFITRHDLSGKVVNIDTNSLRSSMRPGFEDIIRRCIQRFF

SEQ ID NO: 7533 - protein, 40 aa, Artificial Sequence
  Description of Artificial Sequence: Synthetic polypeptide
FITRHDLSGKVVNIDTNSLRSSMRPGFEDIIRRCIQRFFS

SEQ ID NO: 7534 - protein, 40 aa, Artificial Sequence
  Description of Artificial Sequence: Synthetic polypeptide
TRHDLSGKVVNIDTNSLRSSMRPGFEDIIRRCIQRFFSLN

SEQ ID NO: 7535 - protein, 40 aa, Artificial Sequence
  Description of Artificial Sequence: Synthetic polypeptide
RHDLSGKVVNIDTNSLRSSMRPGFEDIIRRCIQRFFSLND

SEQ ID NO: 7536 - protein, 40 aa, Artificial Sequence
  Description of Artificial Sequence: Synthetic polypeptide
DLSGKVVNIDTNSLRSSMRPGFEDIIRRCIQRFFSLNDGQ

SEQ ID NO: 7537 - protein, 40 aa, Artificial Sequence
  Description of Artificial Sequence: Synthetic polypeptide
LSGKVVNIDTNSLRSSMRPGFEDIIRRCIQRFFSLNDGQS

SEQ ID NO: 7538 - protein, 40 aa, Artificial Sequence
  Description of Artificial Sequence: Synthetic polypeptide
GKVVNIDTNSLRSSMRPGFEDIIRRCIQRFFSLNDGQSWS

SEQ ID NO: 7539 - protein, 40 aa, Artificial Sequence
  Description of Artificial Sequence: Synthetic polypeptide
NIDTNSLRSSMRPGFEDIIRRCIQRFFSLNDGQSWSQKRH

SEQ ID NO: 7540 - protein, 40 aa, Artificial Sequence
  Description of Artificial Sequence: Synthetic polypeptide
SLRSSMRPGFEDIIRRCIQRFFSLNDGQSWSQKRHYQEAY

SEQ ID NO: 7541 - protein, 40 aa, Artificial Sequence
  Description of Artificial Sequence: Synthetic polypeptide
RSSMRPGFEDIIRRCIQRFFSLNDGQSWSQKRHYQEAYLN

SEQ ID NO: 7542 - protein, 40 aa, Artificial Sequence
  Description of Artificial Sequence: Synthetic polypeptide
SSMRPGFEDIIRRCIQRFFSLNDGQSWSQKRHYQEAYLNG

SEQ ID NO: 7543 - protein, 40 aa, Artificial Sequence
  Description of Artificial Sequence: Synthetic polypeptide
SMRPGFEDIIRRCIQRFFSLNDGQSWSQKRHYQEAYLNGH

SEQ ID NO: 7544 - protein, 40 aa, Artificial Sequence
  Description of Artificial Sequence: Synthetic polypeptide
FEDIIRRCIQRFFSLNDGQSWSQKRHYQEAYLNGHAETPV

SEQ ID NO: 7545 - protein, 40 aa, Artificial Sequence
  Description of Artificial Sequence: Synthetic polypeptide
EDIIRRCIQRFFSLNDGQSWSQKRHYQEAYLNGHAETPVY

SEQ ID NO: 7546 - protein, 40 aa, Artificial Sequence
  Description of Artificial Sequence: Synthetic polypeptide
RRCIQRFFSLNDGQSWSQKRHYQEAYLNGHAETPVYRFSL

SEQ ID NO: 7547 - protein, 40 aa, Artificial Sequence
  Description of Artificial Sequence: Synthetic polypeptide
LQREQNGYRPNPNPVGQGIRPPMAGCNSSVGGMSMSPNQG

SEQ ID NO: 7548 - protein, 40 aa, Artificial Sequence
  Description of Artificial Sequence: Synthetic polypeptide
PNQQNIMISPRNRGSPKIASHQFSPVAGVHSPMASSGNTG

SEQ ID NO: 7549 - protein, 40 aa, Artificial Sequence
  Description of Artificial Sequence: Synthetic polypeptide
NQQNIMISPRNRGSPKIASHQFSPVAGVHSPMASSGNTGN

SEQ ID NO: 7550 - protein, 40 aa, Artificial Sequence
  Description of Artificial Sequence: Synthetic polypeptide
NIMISPRNRGSPKIASHQFSPVAGVHSPMASSGNTGNHSF

SEQ ID NO: 7551 - protein, 40 aa, Artificial Sequence
  Description of Artificial Sequence: Synthetic polypeptide
AGVHSPMASSGNTGNHSFSSSSLSALQAISEGVGTSLLST

SEQ ID NO: 7552 - protein, 40 aa, Artificial Sequence
  Description of Artificial Sequence: Synthetic polypeptide
GVHSPMASSGNTGNHSFSSSSLSALQAISEGVGTSLLSTL

SEQ ID NO: 7553 - protein, 40 aa, Artificial Sequence
  Description of Artificial Sequence: Synthetic polypeptide
SFSSSSLSALQAISEGVGTSLLSTLSSPGPKLDNSPNMNI

SEQ ID NO: 7554 - protein, 40 aa, Artificial Sequence
  Description of Artificial Sequence: Synthetic polypeptide
GTSLLSTLSSPGPKLDNSPNMNITQPSKVSNQDSKSPLGF

SEQ ID NO: 7555 - protein, 40 aa, Artificial Sequence
  Description of Artificial Sequence: Synthetic polypeptide
LLSTLSSPGPKLDNSPNMNITQPSKVSNQDSKSPLGFYCD

SEQ ID NO: 7556 - protein, 40 aa, Artificial Sequence
  Description of Artificial Sequence: Synthetic polypeptide
PNMNITQPSKVSNQDSKSPLGFYCDQNPVESSMCQSNSRD

SEQ ID NO: 7557 - protein, 40 aa, Artificial Sequence
  Description of Artificial Sequence: Synthetic polypeptide
NITQPSKVSNQDSKSPLGFYCDQNPVESSMCQSNSRDHLS

SEQ ID NO: 7558 - protein, 40 aa, Artificial Sequence
  Description of Artificial Sequence: Synthetic polypeptide
TQPSKVSNQDSKSPLGFYCDQNPVESSMCQSNSRDHLSDK

SEQ ID NO: 7559 - protein, 40 aa, Artificial Sequence
  Description of Artificial Sequence: Synthetic polypeptide
NQDSKSPLGFYCDQNPVESSMCQSNSRDHLSDKESKESSV

SEQ ID NO: 7560 - protein, 40 aa, Artificial Sequence
  Description of Artificial Sequence: Synthetic polypeptide
KSPLGFYCDQNPVESSMCQSNSRDHLSDKESKESSVEGAE

SEQ ID NO: 7561 - protein, 40 aa, Artificial Sequence
  Description of Artificial Sequence: Synthetic polypeptide
CDQNPVESSMCQSNSRDHLSDKESKESSVEGAENQRGPLE

SEQ ID NO: 7562 - protein, 40 aa, Artificial Sequence
  Description of Artificial Sequence: Synthetic polypeptide
PVESSMCQSNSRDHLSDKESKESSVEGAENQRGPLESKGH

SEQ ID NO: 7563 - protein, 40 aa, Artificial Sequence
  Description of Artificial Sequence: Synthetic polypeptide
VESSMCQSNSRDHLSDKESKESSVEGAENQRGPLESKGHK

SEQ ID NO: 7564 - protein, 40 aa, Artificial Sequence
  Description of Artificial Sequence: Synthetic polypeptide
SSMCQSNSRDHLSDKESKESSVEGAENQRGPLESKGHKKL

SEQ ID NO: 7565 - protein, 40 aa, Artificial Sequence
  Description of Artificial Sequence: Synthetic polypeptide
SMCQSNSRDHLSDKESKESSVEGAENQRGPLESKGHKKLL

SEQ ID NO: 7566 - protein, 40 aa, Artificial Sequence
  Description of Artificial Sequence: Synthetic polypeptide
QSNSRDHLSDKESKESSVEGAENQRGPLESKGHKKLLQLL

SEQ ID NO: 7567 - protein, 40 aa, Artificial Sequence
  Description of Artificial Sequence: Synthetic polypeptide
NSRDHLSDKESKESSVEGAENQRGPLESKGHKKLLQLLTC

SEQ ID NO: 7568 - protein, 40 aa, Artificial Sequence
  Description of Artificial Sequence: Synthetic polypeptide
SRDHLSDKESKESSVEGAENQRGPLESKGHKKLLQLLTCS

SEQ ID NO: 7569 - protein, 40 aa, Artificial Sequence
  Description of Artificial Sequence: Synthetic polypeptide
DHLSDKESKESSVEGAENQRGPLESKGHKKLLQLLTCSSD

SEQ ID NO: 7570 - protein, 40 aa, Artificial Sequence
  Description of Artificial Sequence: Synthetic polypeptide
HLSDKESKESSVEGAENQRGPLESKGHKKLLQLLTCSSDD

SEQ ID NO: 7571 - protein, 40 aa, Artificial Sequence
  Description of Artificial Sequence: Synthetic polypeptide
MQLLTCSSDDRGHSSLTNSPLDSSCKESSVSVTSPSGVSS

SEQ ID NO: 7572 - protein, 40 aa, Artificial Sequence
  Description of Artificial Sequence: Synthetic polypeptide
LLTCSSDDRGHSSLTNSPLDSSCKESSVSVTSPSGVSSST

SEQ ID NO: 7573 - protein, 40 aa, Artificial Sequence
  Description of Artificial Sequence: Synthetic polypeptide
LTCSSDDRGHSSLTNSPLDSSCKESSVSVTSPSGVSSSTS

SEQ ID NO: 7574 - protein, 40 aa, Artificial Sequence
  Description of Artificial Sequence: Synthetic polypeptide
DDRGHSSLTNSPLDSSCKESSVSVTSPSGVSSSTSGGVSS

SEQ ID NO: 7575 - protein, 40 aa, Artificial Sequence
  Description of Artificial Sequence: Synthetic polypeptide
QEKHRILHKLLQNGNSPAEVAKITAEATGKDTSSITSCGD

SEQ ID NO: 7576 - protein, 40 aa, Artificial Sequence
  Description of Artificial Sequence: Synthetic polypeptide
TAEATGKDTSSITSCGDGNVVKQEQLSPKKKENNALLRYL

SEQ ID NO: 7577 - protein, 40 aa, Artificial Sequence
  Description of Artificial Sequence: Synthetic polypeptide
PSDALSKELQPQVEGVDNKMSQCTSSTIPSSSQEKDPKIK

SEQ ID NO: 7578 - protein, 40 aa, Artificial Sequence
  Description of Artificial Sequence: Synthetic polypeptide
QVEGVDNKMSQCTSSTIPSSSQEKDPKIKTETSEEGSGDL

SEQ ID NO: 7579 - protein, 40 aa, Artificial Sequence
  Description of Artificial Sequence: Synthetic polypeptide
VEGVDNKMSQCTSSTIPSSSQEKDPKIKTETSEEGSGDLD

SEQ ID NO: 7580 - protein, 40 aa, Artificial Sequence
  Description of Artificial Sequence: Synthetic polypeptide
VDNKMSQCTSSTIPSSSQEKDPKIKTETSEEGSGDLDNLD

SEQ ID NO: 7581 - protein, 40 aa, Artificial Sequence
  Description of Artificial Sequence: Synthetic polypeptide
SQCTSSTIPSSSQEKDPKIKTETSEEGSGDLDNLDAILGD

SEQ ID NO: 7582 - protein, 40 aa, Artificial Sequence
  Description of Artificial Sequence: Synthetic polypeptide
IPSSSQEKDPKIKTETSEEGSGDLDNLDAILGDLTSSDFY

SEQ ID NO: 7583 - protein, 40 aa, Artificial Sequence
  Description of Artificial Sequence: Synthetic polypeptide
PSSSQEKDPKIKTETSEEGSGDLDNLDAILGDLTSSDFYN

SEQ ID NO: 7584 - protein, 40 aa, Artificial Sequence
  Description of Artificial Sequence: Synthetic polypeptide
SSSQEKDPKIKTETSEEGSGDLDNLDAILGDLTSSDFYNN

SEQ ID NO: 7585 - protein, 40 aa, Artificial Sequence
  Description of Artificial Sequence: Synthetic polypeptide
SQEKDPKIKTETSEEGSGDLDNLDAILGDLTSSDFYNNSI

SEQ ID NO: 7586 - protein, 40 aa, Artificial Sequence
  Description of Artificial Sequence: Synthetic polypeptide
EKDPKIKTETSEEGSGDLDNLDAILGDLTSSDFYNNSISS

SEQ ID NO: 7587 - protein, 40 aa, Artificial Sequence
  Description of Artificial Sequence: Synthetic polypeptide
DPKIKTETSEEGSGDLDNLDAILGDLTSSDFYNNSISSNG

SEQ ID NO: 7588 - protein, 40 aa, Artificial Sequence
  Description of Artificial Sequence: Synthetic polypeptide
NSISSNGSHLGTKQQVFQGTNSLGLKSSQSVQSIRPPYNR

SEQ ID NO: 7589 - protein, 40 aa, Artificial Sequence
  Description of Artificial Sequence: Synthetic polypeptide
SSNGSHLGTKQQVFQGTNSLGLKSSQSVQSIRPPYNRAVS

SEQ ID NO: 7590 - protein, 40 aa, Artificial Sequence
  Description of Artificial Sequence: Synthetic polypeptide
QQVFQGTNSLGLKSSQSVQSIRPPYNRAVSLDSPVSVGSS

SEQ ID NO: 7591 - protein, 40 aa, Artificial Sequence
  Description of Artificial Sequence: Synthetic polypeptide
TNSLGLKSSQSVQSIRPPYNRAVSLDSPVSVGSSPPVKNI

SEQ ID NO: 7592 - protein, 40 aa, Artificial Sequence
  Description of Artificial Sequence: Synthetic polypeptide
NSLGLKSSQSVQSIRPPYNRAVSLDSPVSVGSSPPVKNIS

SEQ ID NO: 7593 - protein, 40 aa, Artificial Sequence
  Description of Artificial Sequence: Synthetic polypeptide
MDSPVSVGSSPPVKNISAFPMLPKQPMLGGNPRMMDSQEN

SEQ ID NO: 7594 - protein, 40 aa, Artificial Sequence
  Description of Artificial Sequence: Synthetic polypeptide
QTPSSGDWGLPNSKAGRMEPMNSNSMGRPGGDYNTSLPRP

SEQ ID NO: 7595 - protein, 40 aa, Artificial Sequence
  Description of Artificial Sequence: Synthetic polypeptide
NSMGRPGGDYNTSLPRPALGGSIPTLPLRSNSIPGARPVL

SEQ ID NO: 7596 - protein, 40 aa, Artificial Sequence
  Description of Artificial Sequence: Synthetic polypeptide
GGDYNTSLPRPALGGSIPTLPLRSNSIPGARPVLQQQQQM

SEQ ID NO: 7597 - protein, 40 aa, Artificial Sequence
  Description of Artificial Sequence: Synthetic polypeptide
MDDLVGPPSNLEGQSDERALLDQLHTLLSNTDATGLEEID

SEQ ID NO: 7598 - protein, 40 aa, Artificial Sequence
  Description of Artificial Sequence: Synthetic polypeptide
LVNQGQALEPKQDAFQGQEAAVMMDQKAGLYGQTYPAQGP

SEQ ID NO: 7599 - protein, 40 aa, Artificial Sequence
  Description of Artificial Sequence: Synthetic polypeptide
ALEPKQDAFQGQEAAVMMDQKAGLYGQTYPAQGPPMQGGF

SEQ ID NO: 7600 - protein, 40 aa, Artificial Sequence
  Description of Artificial Sequence: Synthetic polypeptide
PPMQGGFHLQGQSPSFNSMMNQMNQQGNFPLQGMHPRANI

SEQ ID NO: 7601 - protein, 40 aa, Artificial Sequence
  Description of Artificial Sequence: Synthetic polypeptide
RPRTNTPKQLRMQLQQRLQGQQFLNQSRQALELKMENPTA

SEQ ID NO: 7602 - protein, 40 aa, Artificial Sequence
  Description of Artificial Sequence: Synthetic polypeptide
KQLRMQLQQRLQGQQFLNQSRQALELKMENPTAGGAAVMR

SEQ ID NO: 7603 - protein, 40 aa, Artificial Sequence
  Description of Artificial Sequence: Synthetic polypeptide
QRLQGQQFLNQSRQALELKMENPTAGGAAVMRPMMQPQVS

SEQ ID NO: 7604 - protein, 40 aa, Artificial Sequence
  Description of Artificial Sequence: Synthetic polypeptide
RLQGQQFLNQSRQALELKMENPTAGGAAVMRPMMQPQVSS

SEQ ID NO: 7605 - protein, 40 aa, Artificial Sequence
  Description of Artificial Sequence: Synthetic polypeptide
QGQQFLNQSRQALELKMENPTAGGAAVMRPMMQPQVSSQQ

SEQ ID NO: 7606 - protein, 40 aa, Artificial Sequence
  Description of Artificial Sequence: Synthetic polypeptide
GQQFLNQSRQALELKMENPTAGGAAVMRPMMQPQVSSQQG

SEQ ID NO: 7607 - protein, 40 aa, Artificial Sequence
  Description of Artificial Sequence: Synthetic polypeptide
QQFLNQSRQALELKMENPTAGGAAVMRPMMQPQVSSQQGF

SEQ ID NO: 7608 - protein, 40 aa, Artificial Sequence
  Description of Artificial Sequence: Synthetic polypeptide
QFLNQSRQALELKMENPTAGGAAVMRPMMQPQVSSQQGFL

SEQ ID NO: 7609 - protein, 40 aa, Artificial Sequence
  Description of Artificial Sequence: Synthetic polypeptide
MNQSRQALELKMENPTAGGAAVMRPMMQPQVSSQQGFLNA

SEQ ID NO: 7610 - protein, 40 aa, Artificial Sequence
  Description of Artificial Sequence: Synthetic polypeptide
NQSRQALELKMENPTAGGAAVMRPMMQPQVSSQQGFLNAQ

SEQ ID NO: 7611 - protein, 40 aa, Artificial Sequence
  Description of Artificial Sequence: Synthetic polypeptide
QSRQALELKMENPTAGGAAVMRPMMQPQVSSQQGFLNAQM

SEQ ID NO: 7612 - protein, 40 aa, Artificial Sequence
  Description of Artificial Sequence: Synthetic polypeptide
RQALELKMENPTAGGAAVMRPMMQPQVSSQQGFLNAQMVA

SEQ ID NO: 7613 - protein, 40 aa, Artificial Sequence
  Description of Artificial Sequence: Synthetic polypeptide
ALELKMENPTAGGAAVMRPMMQPQVSSQQGFLNAQMVAQR

SEQ ID NO: 7614 - protein, 40 aa, Artificial Sequence
  Description of Artificial Sequence: Synthetic polypeptide
LELKMENPTAGGAAVMRPMMQPQVSSQQGFLNAQMVAQRS

SEQ ID NO: 7615 - protein, 40 aa, Artificial Sequence
  Description of Artificial Sequence: Synthetic polypeptide
ELKMENPTAGGAAVMRPMMQPQVSSQQGFLNAQMVAQRSR

SEQ ID NO: 7616 - protein, 40 aa, Artificial Sequence
  Description of Artificial Sequence: Synthetic polypeptide
MKMENPTAGGAAVMRPMMQPQVSSQQGFLNAQMVAQRSRE

SEQ ID NO: 7617 - protein, 40 aa, Artificial Sequence
  Description of Artificial Sequence: Synthetic polypeptide
ENPTAGGAAVMRPMMQPQVSSQQGFLNAQMVAQRSRELLS

SEQ ID NO: 7618 - protein, 40 aa, Artificial Sequence
  Description of Artificial Sequence: Synthetic polypeptide
RPMMQPQVSSQQGFLNAQMVAQRSRELLSHHFRQQRVAMM

SEQ ID NO: 7619 - protein, 40 aa, Artificial Sequence
  Description of Artificial Sequence: Synthetic polypeptide
MPPPGLPSQQDMDLIDILWRQDIDLGVSREVFDFSQRRKE

SEQ ID NO: 7620 - protein, 40 aa, Artificial Sequence
  Description of Artificial Sequence: Synthetic polypeptide
PPGLPSQQDMDLIDILWRQDIDLGVSREVFDFSQRRKEYE

SEQ ID NO: 7621 - protein, 40 aa, Artificial Sequence
  Description of Artificial Sequence: Synthetic polypeptide
PSQQDMDLIDILWRQDIDLGVSREVFDFSQRRKEYELEKQ

SEQ ID NO: 7622 - protein, 40 aa, Artificial Sequence
  Description of Artificial Sequence: Synthetic polypeptide
DMDLIDILWRQDIDLGVSREVFDFSQRRKEYELEKQKKLE

SEQ ID NO: 7623 - protein, 40 aa, Artificial Sequence
  Description of Artificial Sequence: Synthetic polypeptide
DLIDILWRQDIDLGVSREVFDFSQRRKEYELEKQKKLEKE

SEQ ID NO: 7624 - protein, 40 aa, Artificial Sequence
  Description of Artificial Sequence: Synthetic polypeptide
MIDILWRQDIDLGVSREVFDFSQRRKEYELEKQKKLEKER

SEQ ID NO: 7625 - protein, 40 aa, Artificial Sequence
  Description of Artificial Sequence: Synthetic polypeptide
IDILWRQDIDLGVSREVFDFSQRRKEYELEKQKKLEKERQ

SEQ ID NO: 7626 - protein, 40 aa, Artificial Sequence
  Description of Artificial Sequence: Synthetic polypeptide
DILWRQDIDLGVSREVFDFSQRRKEYELEKQKKLEKERQE

SEQ ID NO: 7627 - protein, 40 aa, Artificial Sequence
  Description of Artificial Sequence: Synthetic polypeptide
ILWRQDIDLGVSREVFDFSQRRKEYELEKQKKLEKERQEQ

SEQ ID NO: 7628 - protein, 40 aa, Artificial Sequence
  Description of Artificial Sequence: Synthetic polypeptide
LWRQDIDLGVSREVFDFSQRRKEYELEKQKKLEKERQEQL

SEQ ID NO: 7629 - protein, 40 aa, Artificial Sequence
  Description of Artificial Sequence: Synthetic polypeptide
WRQDIDLGVSREVFDFSQRRKEYELEKQKKLEKERQEQLQ

SEQ ID NO: 7630 - protein, 40 aa, Artificial Sequence
  Description of Artificial Sequence: Synthetic polypeptide
RQDIDLGVSREVFDFSQRRKEYELEKQKKLEKERQEQLQK

SEQ ID NO: 7631 - protein, 40 aa, Artificial Sequence
  Description of Artificial Sequence: Synthetic polypeptide
KQKKLEKERQEQLQKEQEKAFFAQLQLDEETGEFLPIQPA

SEQ ID NO: 7632 - protein, 40 aa, Artificial Sequence
  Description of Artificial Sequence: Synthetic polypeptide
QKKLEKERQEQLQKEQEKAFFAQLQLDEETGEFLPIQPAQ

SEQ ID NO: 7633 - protein, 40 aa, Artificial Sequence
  Description of Artificial Sequence: Synthetic polypeptide
KKLEKERQEQLQKEQEKAFFAQLQLDEETGEFLPIQPAQH

SEQ ID NO: 7634 - protein, 40 aa, Artificial Sequence
  Description of Artificial Sequence: Synthetic polypeptide
KEQEKAFFAQLQLDEETGEFLPIQPAQHIQSETSGSANYS

SEQ ID NO: 7635 - protein, 40 aa, Artificial Sequence
  Description of Artificial Sequence: Synthetic polypeptide
SANYSQVAHIPKSDALYFDDCMQLLAQTFPFVDDNEVSSA

SEQ ID NO: 7636 - protein, 40 aa, Artificial Sequence
  Description of Artificial Sequence: Synthetic polypeptide
SQVAHIPKSDALYFDDCMQLLAQTFPFVDDNEVSSATFQS

SEQ ID NO: 7637 - protein, 40 aa, Artificial Sequence
  Description of Artificial Sequence: Synthetic polypeptide
VAHIPKSDALYFDDCMQLLAQTFPFVDDNEVSSATFQSLV

SEQ ID NO: 7638 - protein, 40 aa, Artificial Sequence
  Description of Artificial Sequence: Synthetic polypeptide
IPKSDALYFDDCMQLLAQTFPFVDDNEVSSATFQSLVPDI

SEQ ID NO: 7639 - protein, 40 aa, Artificial Sequence
  Description of Artificial Sequence: Synthetic polypeptide
PFVDDNEVSSATFQSLVPDIPGHIESPVFIATNQAQSPET

SEQ ID NO: 7640 - protein, 40 aa, Artificial Sequence
  Description of Artificial Sequence: Synthetic polypeptide
FVDDNEVSSATFQSLVPDIPGHIESPVFIATNQAQSPETS

SEQ ID NO: 7641 - protein, 40 aa, Artificial Sequence
  Description of Artificial Sequence: Synthetic polypeptide
DDNEVSSATFQSLVPDIPGHIESPVFIATNQAQSPETSVA

SEQ ID NO: 7642 - protein, 40 aa, Artificial Sequence
  Description of Artificial Sequence: Synthetic polypeptide
NEVSSATFQSLVPDIPGHIESPVFIATNQAQSPETSVAQV

SEQ ID NO: 7643 - protein, 40 aa, Artificial Sequence
  Description of Artificial Sequence: Synthetic polypeptide
ATFQSLVPDIPGHIESPVFIATNQAQSPETSVAQVAPVDL

SEQ ID NO: 7644 - protein, 40 aa, Artificial Sequence
  Description of Artificial Sequence: Synthetic polypeptide
TFQSLVPDIPGHIESPVFIATNQAQSPETSVAQVAPVDLD

SEQ ID NO: 7645 - protein, 40 aa, Artificial Sequence
  Description of Artificial Sequence: Synthetic polypeptide
QSLVPDIPGHIESPVFIATNQAQSPETSVAQVAPVDLDGM

SEQ ID NO: 7646 - protein, 40 aa, Artificial Sequence
  Description of Artificial Sequence: Synthetic polypeptide
PGHIESPVFIATNQAQSPETSVAQVAPVDLDGMQQDIEQV

SEQ ID NO: 7647 - protein, 40 aa, Artificial Sequence
  Description of Artificial Sequence: Synthetic polypeptide
IESPVFIATNQAQSPETSVAQVAPVDLDGMQQDIEQVWEE

SEQ ID NO: 7648 - protein, 40 aa, Artificial Sequence
  Description of Artificial Sequence: Synthetic polypeptide
SPVFIATNQAQSPETSVAQVAPVDLDGMQQDIEQVWEELL

SEQ ID NO: 7649 - protein, 40 aa, Artificial Sequence
  Description of Artificial Sequence: Synthetic polypeptide
PVFIATNQAQSPETSVAQVAPVDLDGMQQDIEQVWEELLS

SEQ ID NO: 7650 - protein, 40 aa, Artificial Sequence
  Description of Artificial Sequence: Synthetic polypeptide
TSVAQVAPVDLDGMQQDIEQVWEELLSIPELQCLNIENDK

SEQ ID NO: 7651 - protein, 40 aa, Artificial Sequence
  Description of Artificial Sequence: Synthetic polypeptide
VAPVDLDGMQQDIEQVWEELLSIPELQCLNIENDKLVETT

SEQ ID NO: 7652 - protein, 40 aa, Artificial Sequence
  Description of Artificial Sequence: Synthetic polypeptide
APVDLDGMQQDIEQVWEELLSIPELQCLNIENDKLVETTM

SEQ ID NO: 7653 - protein, 40 aa, Artificial Sequence
  Description of Artificial Sequence: Synthetic polypeptide
EELLSIPELQCLNIENDKLVETTMVPSPEAKLTEVDNYHF

SEQ ID NO: 7654 - protein, 40 aa, Artificial Sequence
  Description of Artificial Sequence: Synthetic polypeptide
SIPELQCLNIENDKLVETTMVPSPEAKLTEVDNYHFYSSI

SEQ ID NO: 7655 - protein, 40 aa, Artificial Sequence
  Description of Artificial Sequence: Synthetic polypeptide
ELQCLNIENDKLVETTMVPSPEAKLTEVDNYHFYSSIPSM

SEQ ID NO: 7656 - protein, 40 aa, Artificial Sequence
  Description of Artificial Sequence: Synthetic polypeptide
CLNIENDKLVETTMVPSPEAKLTEVDNYHFYSSIPSMEKE

SEQ ID NO: 7657 - protein, 40 aa, Artificial Sequence
  Description of Artificial Sequence: Synthetic polypeptide
ENDKLVETTMVPSPEAKLTEVDNYHFYSSIPSMEKEVGNC

SEQ ID NO: 7658 - protein, 40 aa, Artificial Sequence
  Description of Artificial Sequence: Synthetic polypeptide
MVPSPEAKLTEVDNYHFYSSIPSMEKEVGNCSPHFLNAFE

SEQ ID NO: 7659 - protein, 40 aa, Artificial Sequence
  Description of Artificial Sequence: Synthetic polypeptide
VDNYHFYSSIPSMEKEVGNCSPHFLNAFEDSFSSILSTED

SEQ ID NO: 7660 - protein, 40 aa, Artificial Sequence
  Description of Artificial Sequence: Synthetic polypeptide
DNYHFYSSIPSMEKEVGNCSPHFLNAFEDSFSSILSTEDP

SEQ ID NO: 7661 - protein, 40 aa, Artificial Sequence
  Description of Artificial Sequence: Synthetic polypeptide
YHFYSSIPSMEKEVGNCSPHFLNAFEDSFSSILSTEDPNQ

SEQ ID NO: 7662 - protein, 40 aa, Artificial Sequence
  Description of Artificial Sequence: Synthetic polypeptide
FYSSIPSMEKEVGNCSPHFLNAFEDSFSSILSTEDPNQLT

SEQ ID NO: 7663 - protein, 40 aa, Artificial Sequence
  Description of Artificial Sequence: Synthetic polypeptide
YSSIPSMEKEVGNCSPHFLNAFEDSFSSILSTEDPNQLTV

SEQ ID NO: 7664 - protein, 40 aa, Artificial Sequence
  Description of Artificial Sequence: Synthetic polypeptide
SSIPSMEKEVGNCSPHFLNAFEDSFSSILSTEDPNQLTVN

SEQ ID NO: 7665 - protein, 40 aa, Artificial Sequence
  Description of Artificial Sequence: Synthetic polypeptide
SIPSMEKEVGNCSPHFLNAFEDSFSSILSTEDPNQLTVNS

SEQ ID NO: 7666 - protein, 40 aa, Artificial Sequence
  Description of Artificial Sequence: Synthetic polypeptide
IPSMEKEVGNCSPHFLNAFEDSFSSILSTEDPNQLTVNSL

SEQ ID NO: 7667 - protein, 40 aa, Artificial Sequence
  Description of Artificial Sequence: Synthetic polypeptide
PSMEKEVGNCSPHFLNAFEDSFSSILSTEDPNQLTVNSLN

SEQ ID NO: 7668 - protein, 40 aa, Artificial Sequence
  Description of Artificial Sequence: Synthetic polypeptide
MEKEVGNCSPHFLNAFEDSFSSILSTEDPNQLTVNSLNSD

SEQ ID NO: 7669 - protein, 40 aa, Artificial Sequence
  Description of Artificial Sequence: Synthetic polypeptide
VGNCSPHFLNAFEDSFSSILSTEDPNQLTVNSLNSDATVN

SEQ ID NO: 7670 - protein, 40 aa, Artificial Sequence
  Description of Artificial Sequence: Synthetic polypeptide
SILSTEDPNQLTVNSLNSDATVNTDFGDEFYSAFIAEPSI

SEQ ID NO: 7671 - protein, 40 aa, Artificial Sequence
  Description of Artificial Sequence: Synthetic polypeptide
LSTEDPNQLTVNSLNSDATVNTDFGDEFYSAFIAEPSISN

SEQ ID NO: 7672 - protein, 40 aa, Artificial Sequence
  Description of Artificial Sequence: Synthetic polypeptide
SMPSPATLSHSLSELLNGPIDVSDLSLCKAFNQNHPESTA

SEQ ID NO: 7673 - protein, 40 aa, Artificial Sequence
  Description of Artificial Sequence: Synthetic polypeptide
MPSPATLSHSLSELLNGPIDVSDLSLCKAFNQNHPESTAE

SEQ ID NO: 7674 - protein, 40 aa, Artificial Sequence
  Description of Artificial Sequence: Synthetic polypeptide
ATLSHSLSELLNGPIDVSDLSLCKAFNQNHPESTAEFNDS

SEQ ID NO: 7675 - protein, 40 aa, Artificial Sequence
  Description of Artificial Sequence: Synthetic polypeptide
VHDAQCENTPEKELPVSPGHRKTPFTKDKHSSRLEAHLTR

SEQ ID NO: 7676 - protein, 40 aa, Artificial Sequence
  Description of Artificial Sequence: Synthetic polypeptide
HDAQCENTPEKELPVSPGHRKTPFTKDKHSSRLEAHLTRD

SEQ ID NO: 7677 - protein, 40 aa, Artificial Sequence
  Description of Artificial Sequence: Synthetic polypeptide
TPEKELPVSPGHRKTPFTKDKHSSRLEAHLTRDELRAKAL

SEQ ID NO: 7678 - protein, 40 aa, Artificial Sequence
  Description of Artificial Sequence: Synthetic polypeptide
RKTPFTKDKHSSRLEAHLTRDELRAKALHIPFPVEKIINL

SEQ ID NO: 7679 - protein, 40 aa, Artificial Sequence
  Description of Artificial Sequence: Synthetic polypeptide
KTPFTKDKHSSRLEAHLTRDELRAKALHIPFPVEKIINLP

SEQ ID NO: 7680 - protein, 40 aa, Artificial Sequence
  Description of Artificial Sequence: Synthetic polypeptide
KHSSRLEAHLTRDELRAKALHIPFPVEKIINLPVVDFNEM

SEQ ID NO: 7681 - protein, 40 aa, Artificial Sequence
  Description of Artificial Sequence: Synthetic polypeptide
FPVEKIINLPVVDFNEMMSKEQFNEAQLALIRDIRRRGKN

SEQ ID NO: 7682 - protein, 40 aa, Artificial Sequence
  Description of Artificial Sequence: Synthetic polypeptide
IINLPVVDFNEMMSKEQFNEAQLALIRDIRRRGKNKVAAQ

SEQ ID NO: 7683 - protein, 40 aa, Artificial Sequence
  Description of Artificial Sequence: Synthetic polypeptide
VVDFNEMMSKEQFNEAQLALIRDIRRRGKNKVAAQNCRKR

SEQ ID NO: 7684 - protein, 40 aa, Artificial Sequence
  Description of Artificial Sequence: Synthetic polypeptide
VDFNEMMSKEQFNEAQLALIRDIRRRGKNKVAAQNCRKRK

SEQ ID NO: 7685 - protein, 40 aa, Artificial Sequence
  Description of Artificial Sequence: Synthetic polypeptide
DFNEMMSKEQFNEAQLALIRDIRRRGKNKVAAQNCRKRKL

SEQ ID NO: 7686 - protein, 40 aa, Artificial Sequence
  Description of Artificial Sequence: Synthetic polypeptide
FNEMMSKEQFNEAQLALIRDIRRRGKNKVAAQNCRKRKLE

SEQ ID NO: 7687 - protein, 40 aa, Artificial Sequence
  Description of Artificial Sequence: Synthetic polypeptide
EMMSKEQFNEAQLALIRDIRRRGKNKVAAQNCRKRKLENI

SEQ ID NO: 7688 - protein, 40 aa, Artificial Sequence
  Description of Artificial Sequence: Synthetic polypeptide
MMSKEQFNEAQLALIRDIRRRGKNKVAAQNCRKRKLENIV

SEQ ID NO: 7689 - protein, 40 aa, Artificial Sequence
  Description of Artificial Sequence: Synthetic polypeptide
MSKEQFNEAQLALIRDIRRRGKNKVAAQNCRKRKLENIVE

SEQ ID NO: 7690 - protein, 40 aa, Artificial Sequence
  Description of Artificial Sequence: Synthetic polypeptide
SKEQFNEAQLALIRDIRRRGKNKVAAQNCRKRKLENIVEL

SEQ ID NO: 7691 - protein, 40 aa, Artificial Sequence
  Description of Artificial Sequence: Synthetic polypeptide
IRRRGKNKVAAQNCRKRKLENIVELEQDLDHLKDEKEKLL

SEQ ID NO: 7692 - protein, 40 aa, Artificial Sequence
  Description of Artificial Sequence: Synthetic polypeptide
EKGENDKSLHLLKKQLSTLYLEVFSMLRDEDGKPYSPSEY

SEQ ID NO: 7693 - protein, 40 aa, Artificial Sequence
  Description of Artificial Sequence: Synthetic polypeptide
KGENDKSLHLLKKQLSTLYLEVFSMLRDEDGKPYSPSEYS

SEQ ID NO: 7694 - protein, 40 aa, Artificial Sequence
  Description of Artificial Sequence: Synthetic polypeptide
KKQLSTLYLEVFSMLRDEDGKPYSPSEYSLQQTRDGNVFL

SEQ ID NO: 7695 - protein, 40 aa, Artificial Sequence
  Description of Artificial Sequence: Synthetic polypeptide
PSSDESSLETSPPDSSQRPSARPASPGSDAEKRKKRRVLF

SEQ ID NO: 7696 - protein, 40 aa, Artificial Sequence
  Description of Artificial Sequence: Synthetic polypeptide
SSQRPSARPASPGSDAEKRKKRRVLFSKAQTLELERRFRQ

SEQ ID NO: 7697 - protein, 40 aa, Artificial Sequence
  Description of Artificial Sequence: Synthetic polypeptide
PGSDAEKRKKRRVLFSKAQTLELERRFRQQRYLSAPEREQ

SEQ ID NO: 7698 - protein, 40 aa, Artificial Sequence
  Description of Artificial Sequence: Synthetic polypeptide
AAESPDLAASAELHAAPGLLRRVVVPVLVRDGQPCGGGGG

SEQ ID NO: 7699 - protein, 40 aa, Artificial Sequence
  Description of Artificial Sequence: Synthetic polypeptide
VPVLVRDGQPCGGGGGGEVGTAAAQEKCGAPPAAACPLPG

SEQ ID NO: 7700 - protein, 40 aa, Artificial Sequence
  Description of Artificial Sequence: Synthetic polypeptide
PVLVRDGQPCGGGGGGEVGTAAAQEKCGAPPAAACPLPGY

SEQ ID NO: 7701 - protein, 40 aa, Artificial Sequence
  Description of Artificial Sequence: Synthetic polypeptide
VLVRDGQPCGGGGGGEVGTAAAQEKCGAPPAAACPLPGYP

SEQ ID NO: 7702 - protein, 40 aa, Artificial Sequence
  Description of Artificial Sequence: Synthetic polypeptide
DGQPCGGGGGGEVGTAAAQEKCGAPPAAACPLPGYPAFGP

SEQ ID NO: 7703 - protein, 40 aa, Artificial Sequence
  Description of Artificial Sequence: Synthetic polypeptide
GQPCGGGGGGEVGTAAAQEKCGAPPAAACPLPGYPAFGPG

SEQ ID NO: 7704 - protein, 40 aa, Artificial Sequence
  Description of Artificial Sequence: Synthetic polypeptide
QPCGGGGGGEVGTAAAQEKCGAPPAAACPLPGYPAFGPGS

SEQ ID NO: 7705 - protein, 40 aa, Artificial Sequence
  Description of Artificial Sequence: Synthetic polypeptide
PCGGGGGGEVGTAAAQEKCGAPPAAACPLPGYPAFGPGSA

SEQ ID NO: 7706 - protein, 40 aa, Artificial Sequence
  Description of Artificial Sequence: Synthetic polypeptide
CGGGGGGEVGTAAAQEKCGAPPAAACPLPGYPAFGPGSAL

SEQ ID NO: 7707 - protein, 40 aa, Artificial Sequence
  Description of Artificial Sequence: Synthetic polypeptide
GGGGGGEVGTAAAQEKCGAPPAAACPLPGYPAFGPGSALG

SEQ ID NO: 7708 - protein, 40 aa, Artificial Sequence
  Description of Artificial Sequence: Synthetic polypeptide
GGGEVGTAAAQEKCGAPPAAACPLPGYPAFGPGSALGLFP

SEQ ID NO: 7709 - protein, 40 aa, Artificial Sequence
  Description of Artificial Sequence: Synthetic polypeptide
GGEVGTAAAQEKCGAPPAAACPLPGYPAFGPGSALGLFPA

SEQ ID NO: 7710 - protein, 40 aa, Artificial Sequence
  Description of Artificial Sequence: Synthetic polypeptide
EVGTAAAQEKCGAPPAAACPLPGYPAFGPGSALGLFPAYQ

SEQ ID NO: 7711 - protein, 40 aa, Artificial Sequence
  Description of Artificial Sequence: Synthetic polypeptide
VGTAAAQEKCGAPPAAACPLPGYPAFGPGSALGLFPAYQH

SEQ ID NO: 7712 - protein, 40 aa, Artificial Sequence
  Description of Artificial Sequence: Synthetic polypeptide
GTAAAQEKCGAPPAAACPLPGYPAFGPGSALGLFPAYQHL

SEQ ID NO: 7713 - protein, 40 aa, Artificial Sequence
  Description of Artificial Sequence: Synthetic polypeptide
LLAPLLCLALLPALAARGPRCSQPGETCLNGGKCEAANGT

SEQ ID NO: 7714 - protein, 40 aa, Artificial Sequence
  Description of Artificial Sequence: Synthetic polypeptide
APLLCLALLPALAARGPRCSQPGETCLNGGKCEAANGTEA

SEQ ID NO: 7715 - protein, 40 aa, Artificial Sequence
  Description of Artificial Sequence: Synthetic polypeptide
RCSQPGETCLNGGKCEAANGTEACVCGGAFVGPRCQDPNP

SEQ ID NO: 7716 - protein, 40 aa, Artificial Sequence
  Description of Artificial Sequence: Synthetic polypeptide
NCEENIDDCPGNNCKNGGACVDGVNTYNCRCPPEWTGQYC

SEQ ID NO: 7717 - protein, 40 aa, Artificial Sequence
  Description of Artificial Sequence: Synthetic polypeptide
NIDDCPGNNCKNGGACVDGVNTYNCRCPPEWTGQYCTEDV

SEQ ID NO: 7718 - protein, 40 aa, Artificial Sequence
  Description of Artificial Sequence: Synthetic polypeptide
DDCPGNNCKNGGACVDGVNTYNCRCPPEWTGQYCTEDVDE

SEQ ID NO: 7719 - protein, 40 aa, Artificial Sequence
  Description of Artificial Sequence: Synthetic polypeptide
DCPGNNCKNGGACVDGVNTYNCRCPPEWTGQYCTEDVDEC

SEQ ID NO: 7720 - protein, 40 aa, Artificial Sequence
  Description of Artificial Sequence: Synthetic polypeptide
CPGNNCKNGGACVDGVNTYNCRCPPEWTGQYCTEDVDECQ

SEQ ID NO: 7721 - protein, 40 aa, Artificial Sequence
  Description of Artificial Sequence: Synthetic polypeptide
NGGACVDGVNTYNCRCPPEWTGQYCTEDVDECQLMPNACQ

SEQ ID NO: 7722 - protein, 40 aa, Artificial Sequence
  Description of Artificial Sequence: Synthetic polypeptide
CESNPCVNGGTCKDMTSGYVCTCREGFSGPNCQTNINECA

SEQ ID NO: 7723 - protein, 40 aa, Artificial Sequence
  Description of Artificial Sequence: Synthetic polypeptide
CWQTHTQYRCECPSGWTGLYCDVPSVSCEVAAQRQGVDVA

SEQ ID NO: 7724 - protein, 40 aa, Artificial Sequence
  Description of Artificial Sequence: Synthetic polypeptide
DVPSVSCEVAAQRQGVDVARLCQHGGLCVDAGNTHHCRCQ

SEQ ID NO: 7725 - protein, 40 aa, Artificial Sequence
  Description of Artificial Sequence: Synthetic polypeptide
VPSVSCEVAAQRQGVDVARLCQHGGLCVDAGNTHHCRCQA

SEQ ID NO: 7726 - protein, 40 aa, Artificial Sequence
  Description of Artificial Sequence: Synthetic polypeptide
AAQRQGVDVARLCQHGGLCVDAGNTHHCRCQAGYTGSYCE

SEQ ID NO: 7727 - protein, 40 aa, Artificial Sequence
  Description of Artificial Sequence: Synthetic polypeptide
DDCNPPVDPVSRSPKCFNNGTCVDQVGGYSCTCPPGFVGE

SEQ ID NO: 7728 - protein, 40 aa, Artificial Sequence
  Description of Artificial Sequence: Synthetic polypeptide
CTCPPGFVGERCEGDVNECLSNPCDARGTQNCVQRVNDFH

SEQ ID NO: 7729 - protein, 40 aa, Artificial Sequence
  Description of Artificial Sequence: Synthetic polypeptide
ERCEGDVNECLSNPCDARGTQNCVQRVNDFHCECRAGHTG

SEQ ID NO: 7730 - protein, 40 aa, Artificial Sequence
  Description of Artificial Sequence: Synthetic polypeptide
SNPCDARGTQNCVQRVNDFHCECRAGHTGRRCESVINGCK

SEQ ID NO: 7731 - protein, 40 aa, Artificial Sequence
  Description of Artificial Sequence: Synthetic polypeptide
ARGTQNCVQRVNDFHCECRAGHTGRRCESVINGCKGKPCK

SEQ ID NO: 7732 - protein, 40 aa, Artificial Sequence
  Description of Artificial Sequence: Synthetic polypeptide
GGTCAVASNTARGFICKCPAGFEGATCENDARTCGSLRCL

SEQ ID NO: 7733 - protein, 40 aa, Artificial Sequence
  Description of Artificial Sequence: Synthetic polypeptide
AGRDIPPPLIEEACELPECQEDAGNKVCSLQCNNHACGWD

SEQ ID NO: 7734 - protein, 40 aa, Artificial Sequence
  Description of Artificial Sequence: Synthetic polypeptide
VPERLAAGTLVVVVLMPPEQLRNSSFHFLRELSRVLHTNV

SEQ ID NO: 7735 - protein, 40 aa, Artificial Sequence
  Description of Artificial Sequence: Synthetic polypeptide
PPEQLRNSSFHFLRELSRVLHTNVVFKRDAHGQQMIFPYY

SEQ ID NO: 7736 - protein, 40 aa, Artificial Sequence
  Description of Artificial Sequence: Synthetic polypeptide
AEGWAAPDALLGQVKASLLPGGSEGGRRRRELDPMDVRGS

SEQ ID NO: 7737 - protein, 40 aa, Artificial Sequence
  Description of Artificial Sequence: Synthetic polypeptide
GWAAPDALLGQVKASLLPGGSEGGRRRRELDPMDVRGSIV

SEQ ID NO: 7738 - protein, 40 aa, Artificial Sequence
  Description of Artificial Sequence: Synthetic polypeptide
PDALLGQVKASLLPGGSEGGRRRRELDPMDVRGSIVYLEI

SEQ ID NO: 7739 - protein, 40 aa, Artificial Sequence
  Description of Artificial Sequence: Synthetic polypeptide
DALLGQVKASLLPGGSEGGRRRRELDPMDVRGSIVYLEID

SEQ ID NO: 7740 - protein, 40 aa, Artificial Sequence
  Description of Artificial Sequence: Synthetic polypeptide
TVEPPPPAQLHFMYVAAAAFVLLFFVGCGVLLSRKRRRQH

SEQ ID NO: 7741 - protein, 40 aa, Artificial Sequence
  Description of Artificial Sequence: Synthetic polypeptide
PPAQLHFMYVAAAAFVLLFFVGCGVLLSRKRRRQHGQLWF

SEQ ID NO: 7742 - protein, 40 aa, Artificial Sequence
  Description of Artificial Sequence: Synthetic polypeptide
PAQLHFMYVAAAAFVLLFFVGCGVLLSRKRRRQHGQLWFP

SEQ ID NO: 7743 - protein, 40 aa, Artificial Sequence
  Description of Artificial Sequence: Synthetic polypeptide
MHFMYVAAAAFVLLFFVGCGVLLSRKRRRQHGQLWFPEGF

SEQ ID NO: 7744 - protein, 40 aa, Artificial Sequence
  Description of Artificial Sequence: Synthetic polypeptide
MYVAAAAFVLLFFVGCGVLLSRKRRRQHGQLWFPEGFKVS

SEQ ID NO: 7745 - protein, 40 aa, Artificial Sequence
  Description of Artificial Sequence: Synthetic polypeptide
KRRRQHGQLWFPEGFKVSEASKKKRREPLGEDSVGLKPLK

SEQ ID NO: 7746 - protein, 40 aa, Artificial Sequence
  Description of Artificial Sequence: Synthetic polypeptide
QLWFPEGFKVSEASKKKRREPLGEDSVGLKPLKNASDGAL

SEQ ID NO: 7747 - protein, 40 aa, Artificial Sequence
  Description of Artificial Sequence: Synthetic polypeptide
LWFPEGFKVSEASKKKRREPLGEDSVGLKPLKNASDGALM

SEQ ID NO: 7748 - protein, 40 aa, Artificial Sequence
  Description of Artificial Sequence: Synthetic polypeptide
ADAQGVFQILIRNRATDLDARMHDGTTPLILAARLAVEGM

SEQ ID NO: 7749 - protein, 40 aa, Artificial Sequence
  Description of Artificial Sequence: Synthetic polypeptide
ALGGGGRLAFETGPPRLSHLPVASGTSTVLGSSSGGALNF

SEQ ID NO: 7750 - protein, 40 aa, Artificial Sequence
  Description of Artificial Sequence: Synthetic polypeptide
MQHGMVGPLHSSLAASALSQMMSYQGLPSTRLATQPHLVQ

SEQ ID NO: 7751 - protein, 40 aa, Artificial Sequence
  Description of Artificial Sequence: Synthetic polypeptide
QPQNLQMQQQNLQPANIQQQQSLQPPPPPPQPHLGVSSAA

SEQ ID NO: 7752 - protein, 40 aa, Artificial Sequence
  Description of Artificial Sequence: Synthetic polypeptide
QSLQPPPPPPQPHLGVSSAASGHLGRSFLSGEPSQADVQP

SEQ ID NO: 7753 - protein, 40 aa, Artificial Sequence
  Description of Artificial Sequence: Synthetic polypeptide
TAGQEEYSAMRDQYMRTGEGFLCVFAINNSKSFADINLYR

SEQ ID NO: 7754 - protein, 40 aa, Artificial Sequence
  Description of Artificial Sequence: Synthetic polypeptide
EYSAMRDQYMRTGEGFLCVFAINNSKSFADINLYREQIKR

SEQ ID NO: 7755 - protein, 40 aa, Artificial Sequence
  Description of Artificial Sequence: Synthetic polypeptide
RDQYMRTGEGFLCVFAINNSKSFADINLYREQIKRVKDSD

SEQ ID NO: 7756 - protein, 40 aa, Artificial Sequence
  Description of Artificial Sequence: Synthetic polypeptide
VFAINNSKSFADINLYREQIKRVKDSDDVPMVLVGNKCDL

SEQ ID NO: 7757 - protein, 40 aa, Artificial Sequence
  Description of Artificial Sequence: Synthetic polypeptide
FAINNSKSFADINLYREQIKRVKDSDDVPMVLVGNKCDLP

SEQ ID NO: 7758 - protein, 40 aa, Artificial Sequence
  Description of Artificial Sequence: Synthetic polypeptide
INNSKSFADINLYREQIKRVKDSDDVPMVLVGNKCDLPTR

SEQ ID NO: 7759 - protein, 40 aa, Artificial Sequence
  Description of Artificial Sequence: Synthetic polypeptide
TRTVDTKQAHELAKSYGIPFIETSAKTRQGVEDAFYTLVR

SEQ ID NO: 7760 - protein, 40 aa, Artificial Sequence
  Description of Artificial Sequence: Synthetic polypeptide
RTVDTKQAHELAKSYGIPFIETSAKTRQGVEDAFYTLVRE

SEQ ID NO: 7761 - protein, 40 aa, Artificial Sequence
  Description of Artificial Sequence: Synthetic polypeptide
TVDTKQAHELAKSYGIPFIETSAKTRQGVEDAFYTLVREI

SEQ ID NO: 7762 - protein, 40 aa, Artificial Sequence
  Description of Artificial Sequence: Synthetic polypeptide
DTKQAHELAKSYGIPFIETSAKTRQGVEDAFYTLVREIRQ

SEQ ID NO: 7763 - protein, 40 aa, Artificial Sequence
  Description of Artificial Sequence: Synthetic polypeptide
MAKSYGIPFIETSAKTRQGVEDAFYTLVREIRQYRMKKLN

SEQ ID NO: 7764 - protein, 40 aa, Artificial Sequence
  Description of Artificial Sequence: Synthetic polypeptide
SYGIPFIETSAKTRQGVEDAFYTLVREIRQYRMKKLNSSD

SEQ ID NO: 7765 - protein, 40 aa, Artificial Sequence
  Description of Artificial Sequence: Synthetic polypeptide
ETSAKTRQGVEDAFYTLVREIRQYRMKKLNSSDDGTQGCM

SEQ ID NO: 7766 - protein, 40 aa, Artificial Sequence
  Description of Artificial Sequence: Synthetic polypeptide
TSAKTRQGVEDAFYTLVREIRQYRMKKLNSSDDGTQGCMG

SEQ ID NO: 7767 - protein, 40 aa, Artificial Sequence
  Description of Artificial Sequence: Synthetic polypeptide
AKTRQGVEDAFYTLVREIRQYRMKKLNSSDDGTQGCMGLP

SEQ ID NO: 7768 - protein, 40 aa, Artificial Sequence
  Description of Artificial Sequence: Synthetic polypeptide
KTRQGVEDAFYTLVREIRQYRMKKLNSSDDGTQGCMGLPC

SEQ ID NO: 7769 - protein, 40 aa, Artificial Sequence; identical to SEQ ID NO: 3225
  Description of Artificial Sequence: Synthetic polypeptide

SEQ ID NO: 7770 - protein, 40 aa, Artificial Sequence
  Description of Artificial Sequence: Synthetic polypeptide
QVVIDGETCLLDILDTAGLEEYSAMRDQYMRTGEGFLCVF

SEQ ID NO: 7771 - protein, 40 aa, Artificial Sequence
  Description of Artificial Sequence: Synthetic polypeptide
TAGLEEYSAMRDQYMRTGEGFLCVFAINNSKSFADINLYR

SEQ ID NO: 7772 - protein, 40 aa, Artificial Sequence
  Description of Artificial Sequence: Synthetic polypeptide
KRSFFALRDQIPELENNEKAPKVVILKKATAYILSVQAET

SEQ ID NO: 7773 - protein, 40 aa, Artificial Sequence
  Description of Artificial Sequence: Synthetic polypeptide
RSFFALRDQIPELENNEKAPKVVILKKATAYILSVQAETQ

SEQ ID NO: 7774 - protein, 40 aa, Artificial Sequence
  Description of Artificial Sequence: Synthetic polypeptide
SFFALRDQIPELENNEKAPKVVILKKATAYILSVQAETQK

SEQ ID NO: 7775 - protein, 40 aa, Artificial Sequence
  Description of Artificial Sequence: Synthetic polypeptide
FFALRDQIPELENNEKAPKVVILKKATAYILSVQAETQKL

SEQ ID NO: 7776 - protein, 40 aa, Artificial Sequence
  Description of Artificial Sequence: Synthetic polypeptide
ALRDQIPELENNEKAPKVVILKKATAYILSVQAETQKLIS

SEQ ID NO: 7777 - protein, 40 aa, Artificial Sequence
  Description of Artificial Sequence: Synthetic polypeptide
DQIPELENNEKAPKVVILKKATAYILSVQAETQKLISEID

SEQ ID NO: 7778 - protein, 40 aa, Artificial Sequence
  Description of Artificial Sequence: Synthetic polypeptide
QIPELENNEKAPKVVILKKATAYILSVQAETQKLISEIDL

SEQ ID NO: 7779 - protein, 40 aa, Artificial Sequence
  Description of Artificial Sequence: Synthetic polypeptide
IPELENNEKAPKVVILKKATAYILSVQAETQKLISEIDLL

SEQ ID NO: 7780 - protein, 40 aa, Artificial Sequence
  Description of Artificial Sequence: Synthetic polypeptide
PELENNEKAPKVVILKKATAYILSVQAETQKLISEIDLLR

SEQ ID NO: 7781 - protein, 40 aa, Artificial Sequence
  Description of Artificial Sequence: Synthetic polypeptide
NNEKAPKVVILKKATAYILSVQAETQKLISEIDLLRKQNE

SEQ ID NO: 7782 - protein, 40 aa, Artificial Sequence
  Description of Artificial Sequence: Synthetic polypeptide
NEKAPKVVILKKATAYILSVQAETQKLISEIDLLRKQNEQ

SEQ ID NO: 7783 - protein, 40 aa, Artificial Sequence
  Description of Artificial Sequence: Synthetic polypeptide
RPSSGELWGIHLMPPRILVECLLPNGMIVTLECLREATLI

SEQ ID NO: 7784 - protein, 40 aa, Artificial Sequence
  Description of Artificial Sequence: Synthetic polypeptide
SSGELWGIHLMPPRILVECLLPNGMIVTLECLREATLITI

SEQ ID NO: 7785 - protein, 40 aa, Artificial Sequence
  Description of Artificial Sequence: Synthetic polypeptide
SGELWGIHLMPPRILVECLLPNGMIVTLECLREATLITIK

SEQ ID NO: 7786 - protein, 40 aa, Artificial Sequence
  Description of Artificial Sequence: Synthetic polypeptide
GELWGIHLMPPRILVECLLPNGMIVTLECLREATLITIKH

SEQ ID NO: 7787 - protein, 40 aa, Artificial Sequence
  Description of Artificial Sequence: Synthetic polypeptide
LVECLLPNGMIVTLECLREATLITIKHELFKEARKYPLHQ

SEQ ID NO: 7788 - protein, 40 aa, Artificial Sequence
  Description of Artificial Sequence: Synthetic polypeptide
CLLPNGMIVTLECLREATLITIKHELFKEARKYPLHQLLQ

SEQ ID NO: 7789 - protein, 40 aa, Artificial Sequence
  Description of Artificial Sequence: Synthetic polypeptide
LLPNGMIVTLECLREATLITIKHELFKEARKYPLHQLLQD

SEQ ID NO: 7790 - protein, 40 aa, Artificial Sequence
  Description of Artificial Sequence: Synthetic polypeptide
LREATLITIKHELFKEARKYPLHQLLQDESSYIFVSVTQE

SEQ ID NO: 7791 - protein, 40 aa, Artificial Sequence
  Description of Artificial Sequence: Synthetic polypeptide
REATLITIKHELFKEARKYPLHQLLQDESSYIFVSVTQEA

SEQ ID NO: 7792 - protein, 40 aa, Artificial Sequence
  Description of Artificial Sequence: Synthetic polypeptide
LFKEARKYPLHQLLQDESSYIFVSVTQEAEREEFFDETRR

SEQ ID NO: 7793 - protein, 40 aa, Artificial Sequence
  Description of Artificial Sequence: Synthetic polypeptide
ARKYPLHQLLQDESSYIFVSVTQEAEREEFFDETRRLCDL

SEQ ID NO: 7794 - protein, 40 aa, Artificial Sequence
  Description of Artificial Sequence: Synthetic polypeptide
RKYPLHQLLQDESSYIFVSVTQEAEREEFFDETRRLCDLR

SEQ ID NO: 7795 - protein, 40 aa, Artificial Sequence
  Description of Artificial Sequence: Synthetic polypeptide
PLHQLLQDESSYIFVSVTQEAEREEFFDETRRLCDLRLFQ

SEQ ID NO: 7796 - protein, 40 aa, Artificial Sequence
  Description of Artificial Sequence: Synthetic polypeptide
SSYIFVSVTQEAEREEFFDETRRLCDLRLFQPFLKVIEPV

SEQ ID NO: 7797 - protein, 40 aa, Artificial Sequence
  Description of Artificial Sequence: Synthetic polypeptide
SYIFVSVTQEAEREEFFDETRRLCDLRLFQPFLKVIEPVG

SEQ ID NO: 7798 - protein, 40 aa, Artificial Sequence
  Description of Artificial Sequence: Synthetic polypeptide
IFVSVTQEAEREEFFDETRRLCDLRLFQPFLKVIEPVGNR

SEQ ID NO: 7799 - protein, 40 aa, Artificial Sequence
  Description of Artificial Sequence: Synthetic polypeptide
FVSVTQEAEREEFFDETRRLCDLRLFQPFLKVIEPVGNRE

SEQ ID NO: 7800 - protein, 40 aa, Artificial Sequence
  Description of Artificial Sequence: Synthetic polypeptide
VSVTQEAEREEFFDETRRLCDLRLFQPFLKVIEPVGNREE

SEQ ID NO: 7801 - protein, 40 aa, Artificial Sequence
  Description of Artificial Sequence: Synthetic polypeptide
SVTQEAEREEFFDETRRLCDLRLFQPFLKVIEPVGNREEK

SEQ ID NO: 7802 - protein, 40 aa, Artificial Sequence
  Description of Artificial Sequence: Synthetic polypeptide
VTQEAEREEFFDETRRLCDLRLFQPFLKVIEPVGNREEKI

SEQ ID NO: 7803 - protein, 40 aa, Artificial Sequence
  Description of Artificial Sequence: Synthetic polypeptide
QEAEREEFFDETRRLCDLRLFQPFLKVIEPVGNREEKILN

SEQ ID NO: 7804 - protein, 40 aa, Artificial Sequence
  Description of Artificial Sequence: Synthetic polypeptide
REEFFDETRRLCDLRLFQPFLKVIEPVGNREEKILNREIG

SEQ ID NO: 7805 - protein, 40 aa, Artificial Sequence
  Description of Artificial Sequence: Synthetic polypeptide
EEFFDETRRLCDLRLFQPFLKVIEPVGNREEKILNREIGF

SEQ ID NO: 7806 - protein, 40 aa, Artificial Sequence
  Description of Artificial Sequence: Synthetic polypeptide
FFDETRRLCDLRLFQPFLKVIEPVGNREEKILNREIGFAI

SEQ ID NO: 7807 - protein, 40 aa, Artificial Sequence
  Description of Artificial Sequence: Synthetic polypeptide
FDETRRLCDLRLFQPFLKVIEPVGNREEKILNREIGFAIG

SEQ ID NO: 7808 - protein, 40 aa, Artificial Sequence
  Description of Artificial Sequence: Synthetic polypeptide
DETRRLCDLRLFQPFLKVIEPVGNREEKILNREIGFAIGM

SEQ ID NO: 7809 - protein, 40 aa, Artificial Sequence
  Description of Artificial Sequence: Synthetic polypeptide
ETRRLCDLRLFQPFLKVIEPVGNREEKILNREIGFAIGMP

SEQ ID NO: 7810 - protein, 40 aa, Artificial Sequence
  Description of Artificial Sequence: Synthetic polypeptide
LCDLRLFQPFLKVIEPVGNREEKILNREIGFAIGMPVCEF

SEQ ID NO: 7811 - protein, 40 aa, Artificial Sequence
  Description of Artificial Sequence: Synthetic polypeptide
RLFQPFLKVIEPVGNREEKILNREIGFAIGMPVCEFDMVK

SEQ ID NO: 7812 - protein, 40 aa, Artificial Sequence
  Description of Artificial Sequence: Synthetic polypeptide
FQPFLKVIEPVGNREEKILNREIGFAIGMPVCEFDMVKDP

SEQ ID NO: 7813 - protein, 40 aa, Artificial Sequence
  Description of Artificial Sequence: Synthetic polypeptide
QPFLKVIEPVGNREEKILNREIGFAIGMPVCEFDMVKDPE

SEQ ID NO: 7814 - protein, 40 aa, Artificial Sequence
  Description of Artificial Sequence: Synthetic polypeptide
REIGFAIGMPVCEFDMVKDPEVQDFRRNILNVCKEAVDLR

SEQ ID NO: 7815 - protein, 40 aa, Artificial Sequence
  Description of Artificial Sequence: Synthetic polypeptide
PVCEFDMVKDPEVQDFRRNILNVCKEAVDLRDLNSPHSRA

SEQ ID NO: 7816 - protein, 40 aa, Artificial Sequence
  Description of Artificial Sequence: Synthetic polypeptide
CEFDMVKDPEVQDFRRNILNVCKEAVDLRDLNSPHSRAMY

SEQ ID NO: 7817 - protein, 40 aa, Artificial Sequence
  Description of Artificial Sequence: Synthetic polypeptide
EVQDFRRNILNVCKEAVDLRDLNSPHSRAMYVYPPNVESS

SEQ ID NO: 7818 - protein, 40 aa, Artificial Sequence
  Description of Artificial Sequence: Synthetic polypeptide
ILNVCKEAVDLRDLNSPHSRAMYVYPPNVESSPELPKHIY

SEQ ID NO: 7819 - protein, 40 aa, Artificial Sequence
  Description of Artificial Sequence: Synthetic polypeptide
MNVCKEAVDLRDLNSPHSRAMYVYPPNVESSPELPKHIYN

SEQ ID NO: 7820 - protein, 40 aa, Artificial Sequence
  Description of Artificial Sequence: Synthetic polypeptide
NVCKEAVDLRDLNSPHSRAMYVYPPNVESSPELPKHIYNK

SEQ ID NO: 7821 - protein, 40 aa, Artificial Sequence
  Description of Artificial Sequence: Synthetic polypeptide
CKEAVDLRDLNSPHSRAMYVYPPNVESSPELPKHIYNKLD

SEQ ID NO: 7822 - protein, 40 aa, Artificial Sequence
  Description of Artificial Sequence: Synthetic polypeptide
RDLNSPHSRAMYVYPPNVESSPELPKHIYNKLDKGQIIVV

SEQ ID NO: 7823 - protein, 40 aa, Artificial Sequence
  Description of Artificial Sequence: Synthetic polypeptide
DLNSPHSRAMYVYPPNVESSPELPKHIYNKLDKGQIIVVI

SEQ ID NO: 7824 - protein, 40 aa, Artificial Sequence
  Description of Artificial Sequence: Synthetic polypeptide
PHSRAMYVYPPNVESSPELPKHIYNKLDKGQIIVVIWVIV

SEQ ID NO: 7825 - protein, 40 aa, Artificial Sequence
  Description of Artificial Sequence: Synthetic polypeptide
SPELPKHIYNKLDKGQIIVVIWVIVSPNNDKQKYTLKINH

SEQ ID NO: 7826 - protein, 40 aa, Artificial Sequence
  Description of Artificial Sequence: Synthetic polypeptide
MPKHIYNKLDKGQIIVVIWVIVSPNNDKQKYTLKINHDCV

SEQ ID NO: 7827 - protein, 40 aa, Artificial Sequence
  Description of Artificial Sequence: Synthetic polypeptide
HIYNKLDKGQIIVVIWVIVSPNNDKQKYTLKINHDCVPEQ

SEQ ID NO: 7828 - protein, 40 aa, Artificial Sequence
  Description of Artificial Sequence: Synthetic polypeptide
NKLDKGQIIVVIWVIVSPNNDKQKYTLKINHDCVPEQVIA

SEQ ID NO: 7829 - protein, 40 aa, Artificial Sequence
  Description of Artificial Sequence: Synthetic polypeptide
KLDKGQIIVVIWVIVSPNNDKQKYTLKINHDCVPEQVIAE

SEQ ID NO: 7830 - protein, 40 aa, Artificial Sequence
  Description of Artificial Sequence: Synthetic polypeptide
DKGQIIVVIWVIVSPNNDKQKYTLKINHDCVPEQVIAEAI

SEQ ID NO: 7831 - protein, 40 aa, Artificial Sequence
  Description of Artificial Sequence: Synthetic polypeptide
IWVIVSPNNDKQKYTLKINHDCVPEQVIAEAIRKKTRSML

SEQ ID NO: 7832 - protein, 40 aa, Artificial Sequence
  Description of Artificial Sequence: Synthetic polypeptide
INHDCVPEQVIAEAIRKKTRSMLLSSEQLKLCVLEYQGKY

SEQ ID NO: 7833 - protein, 40 aa, Artificial Sequence
  Description of Artificial Sequence: Synthetic polypeptide
NHDCVPEQVIAEAIRKKTRSMLLSSEQLKLCVLEYQGKYI

SEQ ID NO: 7834 - protein, 40 aa, Artificial Sequence
  Description of Artificial Sequence: Synthetic polypeptide
HDCVPEQVIAEAIRKKTRSMLLSSEQLKLCVLEYQGKYIL

SEQ ID NO: 7835 - protein, 40 aa, Artificial Sequence
  Description of Artificial Sequence: Synthetic polypeptide
DCVPEQVIAEAIRKKTRSMLLSSEQLKLCVLEYQGKYILK

SEQ ID NO: 7836 - protein, 40 aa, Artificial Sequence
  Description of Artificial Sequence: Synthetic polypeptide
CVPEQVIAEAIRKKTRSMLLSSEQLKLCVLEYQGKYILKV

SEQ ID NO: 7837 - protein, 40 aa, Artificial Sequence
  Description of Artificial Sequence: Synthetic polypeptide
VPEQVIAEAIRKKTRSMLLSSEQLKLCVLEYQGKYILKVC

SEQ ID NO: 7838 - protein, 40 aa, Artificial Sequence
  Description of Artificial Sequence: Synthetic polypeptide
QVIAEAIRKKTRSMLLSSEQLKLCVLEYQGKYILKVCGCD

SEQ ID NO: 7839 - protein, 40 aa, Artificial Sequence
  Description of Artificial Sequence: Synthetic polypeptide
VIAEAIRKKTRSMLLSSEQLKLCVLEYQGKYILKVCGCDE

SEQ ID NO: 7840 - protein, 40 aa, Artificial Sequence
  Description of Artificial Sequence: Synthetic polypeptide
IRKKTRSMLLSSEQLKLCVLEYQGKYILKVCGCDEYFLEK

SEQ ID NO: 7841 - protein, 40 aa, Artificial Sequence
  Description of Artificial Sequence: Synthetic polypeptide
TRSMLLSSEQLKLCVLEYQGKYILKVCGCDEYFLEKYPLS

SEQ ID NO: 7842 - protein, 40 aa, Artificial Sequence
  Description of Artificial Sequence: Synthetic polypeptide
SMLLSSEQLKLCVLEYQGKYILKVCGCDEYFLEKYPLSQY

SEQ ID NO: 7843 - protein, 40 aa, Artificial Sequence
  Description of Artificial Sequence: Synthetic polypeptide
MLLSSEQLKLCVLEYQGKYILKVCGCDEYFLEKYPLSQYK

SEQ ID NO: 7844 - protein, 40 aa, Artificial Sequence
  Description of Artificial Sequence: Synthetic polypeptide
LSSEQLKLCVLEYQGKYILKVCGCDEYFLEKYPLSQYKYI

SEQ ID NO: 7845 - protein, 40 aa, Artificial Sequence
  Description of Artificial Sequence: Synthetic polypeptide
LCVLEYQGKYILKVCGCDEYFLEKYPLSQYKYIRSCIMLG

SEQ ID NO: 7846 - protein, 40 aa, Artificial Sequence
  Description of Artificial Sequence: Synthetic polypeptide
CVLEYQGKYILKVCGCDEYFLEKYPLSQYKYIRSCIMLGR

SEQ ID NO: 7847 - protein, 40 aa, Artificial Sequence
  Description of Artificial Sequence: Synthetic polypeptide
VLEYQGKYILKVCGCDEYFLEKYPLSQYKYIRSCIMLGRM

SEQ ID NO: 7848 - protein, 40 aa, Artificial Sequence
  Description of Artificial Sequence: Synthetic polypeptide
LEYQGKYILKVCGCDEYFLEKYPLSQYKYIRSCIMLGRMP

SEQ ID NO: 7849 - protein, 40 aa, Artificial Sequence
  Description of Artificial Sequence: Synthetic polypeptide
EYQGKYILKVCGCDEYFLEKYPLSQYKYIRSCIMLGRMPN

SEQ ID NO: 7850 - protein, 40 aa, Artificial Sequence
  Description of Artificial Sequence: Synthetic polypeptide
YQGKYILKVCGCDEYFLEKYPLSQYKYIRSCIMLGRMPNL

SEQ ID NO: 7851 - protein, 40 aa, Artificial Sequence
  Description of Artificial Sequence: Synthetic polypeptide
QGKYILKVCGCDEYFLEKYPLSQYKYIRSCIMLGRMPNLM

SEQ ID NO: 7852 - protein, 40 aa, Artificial Sequence
  Description of Artificial Sequence: Synthetic polypeptide
KYILKVCGCDEYFLEKYPLSQYKYIRSCIMLGRMPNLMLM

SEQ ID NO: 7853 - protein, 40 aa, Artificial Sequence
  Description of Artificial Sequence: Synthetic polypeptide
YILKVCGCDEYFLEKYPLSQYKYIRSCIMLGRMPNLMLMA

SEQ ID NO: 7854 - protein, 40 aa, Artificial Sequence
  Description of Artificial Sequence: Synthetic polypeptide
VCGCDEYFLEKYPLSQYKYIRSCIMLGRMPNLMLMAKESL

SEQ ID NO: 7855 - protein, 40 aa, Artificial Sequence
  Description of Artificial Sequence: Synthetic polypeptide
CGCDEYFLEKYPLSQYKYIRSCIMLGRMPNLMLMAKESLY

SEQ ID NO: 7856 - protein, 40 aa, Artificial Sequence
  Description of Artificial Sequence: Synthetic polypeptide
PLSQYKYIRSCIMLGRMPNLMLMAKESLYSQLPMDCFTMP

SEQ ID NO: 7857 - protein, 40 aa, Artificial Sequence
  Description of Artificial Sequence: Synthetic polypeptide
PNLMLMAKESLYSQLPMDCFTMPSYSRRISTATPYMNGET

SEQ ID NO: 7858 - protein, 40 aa, Artificial Sequence
  Description of Artificial Sequence: Synthetic polypeptide
MPSYSRRISTATPYMNGETSTKSLWVINSALRIKILCATY

SEQ ID NO: 7859 - protein, 40 aa, Artificial Sequence
  Description of Artificial Sequence: Synthetic polypeptide
SYSRRISTATPYMNGETSTKSLWVINSALRIKILCATYVN

SEQ ID NO: 7860 - protein, 40 aa, Artificial Sequence
  Description of Artificial Sequence: Synthetic polypeptide
SRRISTATPYMNGETSTKSLWVINSALRIKILCATYVNVN

SEQ ID NO: 7861 - protein, 40 aa, Artificial Sequence
  Description of Artificial Sequence: Synthetic polypeptide
RRISTATPYMNGETSTKSLWVINSALRIKILCATYVNVNI

SEQ ID NO: 7862 - protein, 40 aa, Artificial Sequence
  Description of Artificial Sequence: Synthetic polypeptide
RISTATPYMNGETSTKSLWVINSALRIKILCATYVNVNIR

SEQ ID NO: 7863 - protein, 40 aa, Artificial Sequence
  Description of Artificial Sequence: Synthetic polypeptide
STATPYMNGETSTKSLWVINSALRIKILCATYVNVNIRDI

SEQ ID NO: 7864 - protein, 40 aa, Artificial Sequence
  Description of Artificial Sequence: Synthetic polypeptide
NGETSTKSLWVINSALRIKILCATYVNVNIRDIDKIYVRT

SEQ ID NO: 7865 - protein, 40 aa, Artificial Sequence
  Description of Artificial Sequence: Synthetic polypeptide
GETSTKSLWVINSALRIKILCATYVNVNIRDIDKIYVRTG

SEQ ID NO: 7866 - protein, 40 aa, Artificial Sequence
  Description of Artificial Sequence: Synthetic polypeptide
TSTKSLWVINSALRIKILCATYVNVNIRDIDKIYVRTGIY

SEQ ID NO: 7867 - protein, 40 aa, Artificial Sequence
  Description of Artificial Sequence: Synthetic polypeptide
SLWVINSALRIKILCATYVNVNIRDIDKIYVRTGIYHGGE

SEQ ID NO: 7868 - protein, 40 aa, Artificial Sequence
  Description of Artificial Sequence: Synthetic polypeptide
WVINSALRIKILCATYVNVNIRDIDKIYVRTGIYHGGEPL

SEQ ID NO: 7869 - protein, 40 aa, Artificial Sequence
  Description of Artificial Sequence: Synthetic polypeptide
VINSALRIKILCATYVNVNIRDIDKIYVRTGIYHGGEPLC

SEQ ID NO: 7870 - protein, 40 aa, Artificial Sequence
  Description of Artificial Sequence: Synthetic polypeptide
RIKILCATYVNVNIRDIDKIYVRTGIYHGGEPLCDNVNTQ

SEQ ID NO: 7871 - protein, 40 aa, Artificial Sequence
  Description of Artificial Sequence: Synthetic polypeptide
ATYVNVNIRDIDKIYVRTGIYHGGEPLCDNVNTQRVPCSN

SEQ ID NO: 7872 - protein, 40 aa, Artificial Sequence
  Description of Artificial Sequence: Synthetic polypeptide
YVNVNIRDIDKIYVRTGIYHGGEPLCDNVNTQRVPCSNPR

SEQ ID NO: 7873 - protein, 40 aa, Artificial Sequence
  Description of Artificial Sequence: Synthetic polypeptide
VNVNIRDIDKIYVRTGIYHGGEPLCDNVNTQRVPCSNPRW

SEQ ID NO: 7874 - protein, 40 aa, Artificial Sequence
  Description of Artificial Sequence: Synthetic polypeptide
VNIRDIDKIYVRTGIYHGGEPLCDNVNTQRVPCSNPRWNE

SEQ ID NO: 7875 - protein, 40 aa, Artificial Sequence
  Description of Artificial Sequence: Synthetic polypeptide
DKIYVRTGIYHGGEPLCDNVNTQRVPCSNPRWNEWLNYDI

SEQ ID NO: 7876 - protein, 40 aa, Artificial Sequence
  Description of Artificial Sequence: Synthetic polypeptide
IYVRTGIYHGGEPLCDNVNTQRVPCSNPRWNEWLNYDIYI

SEQ ID NO: 7877 - protein, 40 aa, Artificial Sequence
  Description of Artificial Sequence: Synthetic polypeptide
GIYHGGEPLCDNVNTQRVPCSNPRWNEWLNYDIYIPDLPR

SEQ ID NO: 7878 - protein, 40 aa, Artificial Sequence
  Description of Artificial Sequence: Synthetic polypeptide
TQRVPCSNPRWNEWLNYDIYIPDLPRAARLCLSICSVKGR

SEQ ID NO: 7879 - protein, 40 aa, Artificial Sequence
  Description of Artificial Sequence: Synthetic polypeptide
NPRWNEWLNYDIYIPDLPRAARLCLSICSVKGRKGAKEEH

SEQ ID NO: 7880 - protein, 40 aa, Artificial Sequence
  Description of Artificial Sequence: Synthetic polypeptide
PRWNEWLNYDIYIPDLPRAARLCLSICSVKGRKGAKEEHC

SEQ ID NO: 7881 - protein, 40 aa, Artificial Sequence
  Description of Artificial Sequence: Synthetic polypeptide
PLAWGNINLFDYTDTLVSGKMALNLWPVPHGLEDLLNPIG

SEQ ID NO: 7882 - protein, 40 aa, Artificial Sequence
  Description of Artificial Sequence: Synthetic polypeptide
YTDTLVSGKMALNLWPVPHGLEDLLNPIGVTGSNPNKETP

SEQ ID NO: 7883 - protein, 40 aa, Artificial Sequence
  Description of Artificial Sequence: Synthetic polypeptide
DTLVSGKMALNLWPVPHGLEDLLNPIGVTGSNPNKETPCL

SEQ ID NO: 7884 - protein, 40 aa, Artificial Sequence
  Description of Artificial Sequence: Synthetic polypeptide
TLVSGKMALNLWPVPHGLEDLLNPIGVTGSNPNKETPCLE

SEQ ID NO: 7885 - protein, 40 aa, Artificial Sequence
  Description of Artificial Sequence: Synthetic polypeptide
LVSGKMALNLWPVPHGLEDLLNPIGVTGSNPNKETPCLEL

SEQ ID NO: 7886 - protein, 40 aa, Artificial Sequence
  Description of Artificial Sequence: Synthetic polypeptide
VSGKMALNLWPVPHGLEDLLNPIGVTGSNPNKETPCLELE

SEQ ID NO: 7887 - protein, 40 aa, Artificial Sequence
  Description of Artificial Sequence: Synthetic polypeptide
SGKMALNLWPVPHGLEDLLNPIGVTGSNPNKETPCLELEF

SEQ ID NO: 7888 - protein, 40 aa, Artificial Sequence
  Description of Artificial Sequence: Synthetic polypeptide
GKMALNLWPVPHGLEDLLNPIGVTGSNPNKETPCLELEFD

SEQ ID NO: 7889 - protein, 40 aa, Artificial Sequence
  Description of Artificial Sequence: Synthetic polypeptide
KMALNLWPVPHGLEDLLNPIGVTGSNPNKETPCLELEFDW

SEQ ID NO: 7890 - protein, 40 aa, Artificial Sequence
  Description of Artificial Sequence: Synthetic polypeptide
MALNLWPVPHGLEDLLNPIGVTGSNPNKETPCLELEFDWF

SEQ ID NO: 7891 - protein, 40 aa, Artificial Sequence
  Description of Artificial Sequence: Synthetic polypeptide
ALNLWPVPHGLEDLLNPIGVTGSNPNKETPCLELEFDWFS

SEQ ID NO: 7892 - protein, 40 aa, Artificial Sequence
  Description of Artificial Sequence: Synthetic polypeptide
MNLWPVPHGLEDLLNPIGVTGSNPNKETPCLELEFDWFSS

SEQ ID NO: 7893 - protein, 40 aa, Artificial Sequence
  Description of Artificial Sequence: Synthetic polypeptide
NLWPVPHGLEDLLNPIGVTGSNPNKETPCLELEFDWFSSV

SEQ ID NO: 7894 - protein, 40 aa, Artificial Sequence
  Description of Artificial Sequence: Synthetic polypeptide
LWPVPHGLEDLLNPIGVTGSNPNKETPCLELEFDWFSSVV

SEQ ID NO: 7895 - protein, 40 aa, Artificial Sequence
  Description of Artificial Sequence: Synthetic polypeptide
WPVPHGLEDLLNPIGVTGSNPNKETPCLELEFDWFSSVVK

SEQ ID NO: 7896 - protein, 40 aa, Artificial Sequence
  Description of Artificial Sequence: Synthetic polypeptide
PVPHGLEDLLNPIGVTGSNPNKETPCLELEFDWFSSVVKF

SEQ ID NO: 7897 - protein, 40 aa, Artificial Sequence
  Description of Artificial Sequence: Synthetic polypeptide
VPHGLEDLLNPIGVTGSNPNKETPCLELEFDWFSSVVKFP

SEQ ID NO: 7898 - protein, 40 aa, Artificial Sequence
  Description of Artificial Sequence: Synthetic polypeptide
PHGLEDLLNPIGVTGSNPNKETPCLELEFDWFSSVVKFPD

SEQ ID NO: 7899 - protein, 40 aa, Artificial Sequence
  Description of Artificial Sequence: Synthetic polypeptide
HGLEDLLNPIGVTGSNPNKETPCLELEFDWFSSVVKFPDM

SEQ ID NO: 7900 - protein, 40 aa, Artificial Sequence
  Description of Artificial Sequence: Synthetic polypeptide
GLEDLLNPIGVTGSNPNKETPCLELEFDWFSSVVKFPDMS

SEQ ID NO: 7901 - protein, 40 aa, Artificial Sequence
  Description of Artificial Sequence: Synthetic polypeptide
LEDLLNPIGVTGSNPNKETPCLELEFDWFSSVVKFPDMSV

SEQ ID NO: 7902 - protein, 40 aa, Artificial Sequence
  Description of Artificial Sequence: Synthetic polypeptide
MNPIGVTGSNPNKETPCLELEFDWFSSVVKFPDMSVIEEH

SEQ ID NO: 7903 - protein, 40 aa, Artificial Sequence
  Description of Artificial Sequence: Synthetic polypeptide
PIGVTGSNPNKETPCLELEFDWFSSVVKFPDMSVIEEHAN

SEQ ID NO: 7904 - protein, 40 aa, Artificial Sequence
  Description of Artificial Sequence: Synthetic polypeptide
TGSNPNKETPCLELEFDWFSSVVKFPDMSVIEEHANWSVS

SEQ ID NO: 7905 - protein, 40 aa, Artificial Sequence
  Description of Artificial Sequence: Synthetic polypeptide
GSNPNKETPCLELEFDWFSSVVKFPDMSVIEEHANWSVSR

SEQ ID NO: 7906 - protein, 40 aa, Artificial Sequence
  Description of Artificial Sequence: Synthetic polypeptide
TPCLELEFDWFSSVVKFPDMSVIEEHANWSVSREAGFSYS

SEQ ID NO: 7907 - protein, 40 aa, Artificial Sequence
  Description of Artificial Sequence: Synthetic polypeptide
KFPDMSVIEEHANWSVSREAGFSYSHAGLSNRLARDNELR

SEQ ID NO: 7908 - protein, 40 aa, Artificial Sequence
  Description of Artificial Sequence: Synthetic polypeptide
ITEQEKDFLWSHRHYCVTIPEILPKLLLSVKWNSRDEVAQ

SEQ ID NO: 7909 - protein, 40 aa, Artificial Sequence
  Description of Artificial Sequence: Synthetic polypeptide
KDFLWSHRHYCVTIPEILPKLLLSVKWNSRDEVAQMYCLV

SEQ ID NO: 7910 - protein, 40 aa, Artificial Sequence
  Description of Artificial Sequence: Synthetic polypeptide
TIPEILPKLLLSVKWNSRDEVAQMYCLVKDWPPIKPEQAM

SEQ ID NO: 7911 - protein, 40 aa, Artificial Sequence
  Description of Artificial Sequence: Synthetic polypeptide
IPEILPKLLLSVKWNSRDEVAQMYCLVKDWPPIKPEQAME

SEQ ID NO: 7912 - protein, 40 aa, Artificial Sequence
  Description of Artificial Sequence: Synthetic polypeptide
PKLLLSVKWNSRDEVAQMYCLVKDWPPIKPEQAMELLDCN

SEQ ID NO: 7913 - protein, 40 aa, Artificial Sequence
  Description of Artificial Sequence: Synthetic polypeptide
WNSRDEVAQMYCLVKDWPPIKPEQAMELLDCNYPDPMVRG

SEQ ID NO: 7914 - protein, 40 aa, Artificial Sequence
  Description of Artificial Sequence: Synthetic polypeptide
MVKDWPPIKPEQAMELLDCNYPDPMVRGFAVRCLEKYLTD

SEQ ID NO: 7915 - protein, 40 aa, Artificial Sequence
  Description of Artificial Sequence: Synthetic polypeptide
QAMELLDCNYPDPMVRGFAVRCLEKYLTDDKLSQYLIQLV

SEQ ID NO: 7916 - protein, 40 aa, Artificial Sequence
  Description of Artificial Sequence: Synthetic polypeptide
CNYPDPMVRGFAVRCLEKYLTDDKLSQYLIQLVQVLKYEQ

SEQ ID NO: 7917 - protein, 40 aa, Artificial Sequence
  Description of Artificial Sequence: Synthetic polypeptide
PDPMVRGFAVRCLEKYLTDDKLSQYLIQLVQVLKYEQYLD

SEQ ID NO: 7918 - protein, 40 aa, Artificial Sequence
  Description of Artificial Sequence: Synthetic polypeptide
DPMVRGFAVRCLEKYLTDDKLSQYLIQLVQVLKYEQYLDN

SEQ ID NO: 7919 - protein, 40 aa, Artificial Sequence
  Description of Artificial Sequence: Synthetic polypeptide
MVRGFAVRCLEKYLTDDKLSQYLIQLVQVLKYEQYLDNLL

SEQ ID NO: 7920 - protein, 40 aa, Artificial Sequence
  Description of Artificial Sequence: Synthetic polypeptide
GFAVRCLEKYLTDDKLSQYLIQLVQVLKYEQYLDNLLVRF

SEQ ID NO: 7921 - protein, 40 aa, Artificial Sequence
  Description of Artificial Sequence: Synthetic polypeptide
AVRCLEKYLTDDKLSQYLIQLVQVLKYEQYLDNLLVRFLL

SEQ ID NO: 7922 - protein, 40 aa, Artificial Sequence
  Description of Artificial Sequence: Synthetic polypeptide
VRCLEKYLTDDKLSQYLIQLVQVLKYEQYLDNLLVRFLLK

SEQ ID NO: 7923 - protein, 40 aa, Artificial Sequence
  Description of Artificial Sequence: Synthetic polypeptide
RCLEKYLTDDKLSQYLIQLVQVLKYEQYLDNLLVRFLLKK

SEQ ID NO: 7924 - protein, 40 aa, Artificial Sequence
  Description of Artificial Sequence: Synthetic polypeptide
CLEKYLTDDKLSQYLIQLVQVLKYEQYLDNLLVRFLLKKA

SEQ ID NO: 7925 - protein, 40 aa, Artificial Sequence
  Description of Artificial Sequence: Synthetic polypeptide
MEKYLTDDKLSQYLIQLVQVLKYEQYLDNLLVRFLLKKAL

SEQ ID NO: 7926 - protein, 40 aa, Artificial Sequence
  Description of Artificial Sequence: Synthetic polypeptide
EKYLTDDKLSQYLIQLVQVLKYEQYLDNLLVRFLLKKALT

SEQ ID NO: 7927 - protein, 40 aa, Artificial Sequence
  Description of Artificial Sequence: Synthetic polypeptide
KYLTDDKLSQYLIQLVQVLKYEQYLDNLLVRFLLKKALTN

SEQ ID NO: 7928 - protein, 40 aa, Artificial Sequence
  Description of Artificial Sequence: Synthetic polypeptide
YLTDDKLSQYLIQLVQVLKYEQYLDNLLVRFLLKKALTNQ

SEQ ID NO: 7929 - protein, 40 aa, Artificial Sequence
  Description of Artificial Sequence: Synthetic polypeptide
DDKLSQYLIQLVQVLKYEQYLDNLLVRFLLKKALTNQRIG

SEQ ID NO: 7930 - protein, 40 aa, Artificial Sequence
  Description of Artificial Sequence: Synthetic polypeptide
DKLSQYLIQLVQVLKYEQYLDNLLVRFLLKKALTNQRIGH

SEQ ID NO: 7931 - protein, 40 aa, Artificial Sequence
  Description of Artificial Sequence: Synthetic polypeptide
KLSQYLIQLVQVLKYEQYLDNLLVRFLLKKALTNQRIGHF

SEQ ID NO: 7932 - protein, 40 aa, Artificial Sequence
  Description of Artificial Sequence: Synthetic polypeptide
LSQYLIQLVQVLKYEQYLDNLLVRFLLKKALTNQRIGHFF

SEQ ID NO: 7933 - protein, 40 aa, Artificial Sequence
  Description of Artificial Sequence: Synthetic polypeptide
SQYLIQLVQVLKYEQYLDNLLVRFLLKKALTNQRIGHFFF

SEQ ID NO: 7934 - protein, 40 aa, Artificial Sequence
  Description of Artificial Sequence: Synthetic polypeptide
QYLIQLVQVLKYEQYLDNLLVRFLLKKALTNQRIGHFFFW

SEQ ID NO: 7935 - protein, 40 aa, Artificial Sequence
  Description of Artificial Sequence: Synthetic polypeptide
YLIQLVQVLKYEQYLDNLLVRFLLKKALTNQRIGHFFFWH

SEQ ID NO: 7936 - protein, 40 aa, Artificial Sequence
  Description of Artificial Sequence: Synthetic polypeptide
IQLVQVLKYEQYLDNLLVRFLLKKALTNQRIGHFFFWHLK

SEQ ID NO: 7937 - protein, 40 aa, Artificial Sequence
  Description of Artificial Sequence: Synthetic polypeptide
QLVQVLKYEQYLDNLLVRFLLKKALTNQRIGHFFFWHLKS

SEQ ID NO: 7938 - protein, 40 aa, Artificial Sequence
  Description of Artificial Sequence: Synthetic polypeptide
LVQVLKYEQYLDNLLVRFLLKKALTNQRIGHFFFWHLKSE

SEQ ID NO: 7939 - protein, 40 aa, Artificial Sequence
  Description of Artificial Sequence: Synthetic polypeptide
VQVLKYEQYLDNLLVRFLLKKALTNQRIGHFFFWHLKSEM

SEQ ID NO: 7940 - protein, 40 aa, Artificial Sequence
  Description of Artificial Sequence: Synthetic polypeptide
QVLKYEQYLDNLLVRFLLKKALTNQRIGHFFFWHLKSEMH

SEQ ID NO: 7941 - protein, 40 aa, Artificial Sequence
  Description of Artificial Sequence: Synthetic polypeptide
KYEQYLDNLLVRFLLKKALTNQRIGHFFFWHLKSEMHNKT

SEQ ID NO: 7942 - protein, 40 aa, Artificial Sequence
  Description of Artificial Sequence: Synthetic polypeptide
QYLDNLLVRFLLKKALTNQRIGHFFFWHLKSEMHNKTVSQ

SEQ ID NO: 7943 - protein, 40 aa, Artificial Sequence
  Description of Artificial Sequence: Synthetic polypeptide
MLVRFLLKKALTNQRIGHFFFWHLKSEMHNKTVSQRFGLL

SEQ ID NO: 7944 - protein, 40 aa, Artificial Sequence
  Description of Artificial Sequence: Synthetic polypeptide
RFLLKKALTNQRIGHFFFWHLKSEMHNKTVSQRFGLLLES

SEQ ID NO: 7945 - protein, 40 aa, Artificial Sequence
  Description of Artificial Sequence: Synthetic polypeptide
QRIGHFFFWHLKSEMHNKTVSQRFGLLLESYCRACGMYLK

SEQ ID NO: 7946 - protein, 40 aa, Artificial Sequence
  Description of Artificial Sequence: Synthetic polypeptide
RIGHFFFWHLKSEMHNKTVSQRFGLLLESYCRACGMYLKH

SEQ ID NO: 7947 - protein, 40 aa, Artificial Sequence
  Description of Artificial Sequence: Synthetic polypeptide
IGHFFFWHLKSEMHNKTVSQRFGLLLESYCRACGMYLKHL

SEQ ID NO: 7948 - protein, 40 aa, Artificial Sequence
  Description of Artificial Sequence: Synthetic polypeptide
HFFFWHLKSEMHNKTVSQRFGLLLESYCRACGMYLKHLNR

SEQ ID NO: 7949 - protein, 40 aa, Artificial Sequence
  Description of Artificial Sequence: Synthetic polypeptide
FFFWHLKSEMHNKTVSQRFGLLLESYCRACGMYLKHLNRQ

SEQ ID NO: 7950 - protein, 40 aa, Artificial Sequence
  Description of Artificial Sequence: Synthetic polypeptide
WHLKSEMHNKTVSQRFGLLLESYCRACGMYLKHLNRQVEA

SEQ ID NO: 7951 - protein, 40 aa, Artificial Sequence
  Description of Artificial Sequence: Synthetic polypeptide
HLKSEMHNKTVSQRFGLLLESYCRACGMYLKHLNRQVEAM

SEQ ID NO: 7952 - protein, 40 aa, Artificial Sequence
  Description of Artificial Sequence: Synthetic polypeptide
SEMHNKTVSQRFGLLLESYCRACGMYLKHLNRQVEAMEKL

SEQ ID NO: 7953 - protein, 40 aa, Artificial Sequence
  Description of Artificial Sequence: Synthetic polypeptide
NKTVSQRFGLLLESYCRACGMYLKHLNRQVEAMEKLINLT

SEQ ID NO: 7954 - protein, 40 aa, Artificial Sequence
  Description of Artificial Sequence: Synthetic polypeptide
RFGLLLESYCRACGMYLKHLNRQVEAMEKLINLTDILKQE

SEQ ID NO: 7955 - protein, 40 aa, Artificial Sequence
  Description of Artificial Sequence: Synthetic polypeptide
YCRACGMYLKHLNRQVEAMEKLINLTDILKQEKKDETQKV

SEQ ID NO: 7956 - protein, 40 aa, Artificial Sequence
  Description of Artificial Sequence: Synthetic polypeptide
CRACGMYLKHLNRQVEAMEKLINLTDILKQEKKDETQKVQ

SEQ ID NO: 7957 - protein, 40 aa, Artificial Sequence
  Description of Artificial Sequence: Synthetic polypeptide
CGMYLKHLNRQVEAMEKLINLTDILKQEKKDETQKVQMKF

SEQ ID NO: 7958 - protein, 40 aa, Artificial Sequence
  Description of Artificial Sequence: Synthetic polypeptide
MYLKHLNRQVEAMEKLINLTDILKQEKKDETQKVQMKFLV

SEQ ID NO: 7959 - protein, 40 aa, Artificial Sequence
  Description of Artificial Sequence: Synthetic polypeptide
NRQVEAMEKLINLTDILKQEKKDETQKVQMKFLVEQMRRP

SEQ ID NO: 7960 - protein, 40 aa, Artificial Sequence
  Description of Artificial Sequence: Synthetic polypeptide
RQVEAMEKLINLTDILKQEKKDETQKVQMKFLVEQMRRPD

SEQ ID NO: 7961 - protein, 40 aa, Artificial Sequence
  Description of Artificial Sequence: Synthetic polypeptide
VEAMEKLINLTDILKQEKKDETQKVQMKFLVEQMRRPDFM

SEQ ID NO: 7962 - protein, 40 aa, Artificial Sequence
  Description of Artificial Sequence: Synthetic polypeptide
EAMEKLINLTDILKQEKKDETQKVQMKFLVEQMRRPDFMD

SEQ ID NO: 7963 - protein, 40 aa, Artificial Sequence
  Description of Artificial Sequence: Synthetic polypeptide
AMEKLINLTDILKQEKKDETQKVQMKFLVEQMRRPDFMDA

SEQ ID NO: 7964 - protein, 40 aa, Artificial Sequence
  Description of Artificial Sequence: Synthetic polypeptide
MEKLINLTDILKQEKKDETQKVQMKFLVEQMRRPDFMDAL

SEQ ID NO: 7965 - protein, 40 aa, Artificial Sequence
  Description of Artificial Sequence: Synthetic polypeptide
KLINLTDILKQEKKDETQKVQMKFLVEQMRRPDFMDALQG

SEQ ID NO: 7966 - protein, 40 aa, Artificial Sequence
  Description of Artificial Sequence: Synthetic polypeptide
NLTDILKQEKKDETQKVQMKFLVEQMRRPDFMDALQGFLS

SEQ ID NO: 7967 - protein, 40 aa, Artificial Sequence
  Description of Artificial Sequence: Synthetic polypeptide
DILKQEKKDETQKVQMKFLVEQMRRPDFMDALQGFLSPLN

SEQ ID NO: 7968 - protein, 40 aa, Artificial Sequence
  Description of Artificial Sequence: Synthetic polypeptide
LKQEKKDETQKVQMKFLVEQMRRPDFMDALQGFLSPLNPA

SEQ ID NO: 7969 - protein, 40 aa, Artificial Sequence
  Description of Artificial Sequence: Synthetic polypeptide
QEKKDETQKVQMKFLVEQMRRPDFMDALQGFLSPLNPAHQ

SEQ ID NO: 7970 - protein, 40 aa, Artificial Sequence
  Description of Artificial Sequence: Synthetic polypeptide
KDETQKVQMKFLVEQMRRPDFMDALQGFLSPLNPAHQLGN

SEQ ID NO: 7971 - protein, 40 aa, Artificial Sequence
  Description of Artificial Sequence: Synthetic polypeptide
DETQKVQMKFLVEQMRRPDFMDALQGFLSPLNPAHQLGNL

SEQ ID NO: 7972 - protein, 40 aa, Artificial Sequence
  Description of Artificial Sequence: Synthetic polypeptide
ETQKVQMKFLVEQMRRPDFMDALQGFLSPLNPAHQLGNLR

SEQ ID NO: 7973 - protein, 40 aa, Artificial Sequence
  Description of Artificial Sequence: Synthetic polypeptide
TQKVQMKFLVEQMRRPDFMDALQGFLSPLNPAHQLGNLRL

SEQ ID NO: 7974 - protein, 40 aa, Artificial Sequence
  Description of Artificial Sequence: Synthetic polypeptide
VQMKFLVEQMRRPDFMDALQGFLSPLNPAHQLGNLRLEEC

SEQ ID NO: 7975 - protein, 40 aa, Artificial Sequence
  Description of Artificial Sequence: Synthetic polypeptide
MKFLVEQMRRPDFMDALQGFLSPLNPAHQLGNLRLEECRI

SEQ ID NO: 7976 - protein, 40 aa, Artificial Sequence
  Description of Artificial Sequence: Synthetic polypeptide
KFLVEQMRRPDFMDALQGFLSPLNPAHQLGNLRLEECRIM

SEQ ID NO: 7977 - protein, 40 aa, Artificial Sequence
  Description of Artificial Sequence: Synthetic polypeptide
VEQMRRPDFMDALQGFLSPLNPAHQLGNLRLEECRIMSSA

SEQ ID NO: 7978 - protein, 40 aa, Artificial Sequence
  Description of Artificial Sequence: Synthetic polypeptide
MRRPDFMDALQGFLSPLNPAHQLGNLRLEECRIMSSAKRP

SEQ ID NO: 7979 - protein, 40 aa, Artificial Sequence
  Description of Artificial Sequence: Synthetic polypeptide
RRPDFMDALQGFLSPLNPAHQLGNLRLEECRIMSSAKRPL

SEQ ID NO: 7980 - protein, 40 aa, Artificial Sequence
  Description of Artificial Sequence: Synthetic polypeptide
PDFMDALQGFLSPLNPAHQLGNLRLEECRIMSSAKRPLWL

SEQ ID NO: 7981 - protein, 40 aa, Artificial Sequence
  Description of Artificial Sequence: Synthetic polypeptide
ALQGFLSPLNPAHQLGNLRLEECRIMSSAKRPLWLNWENP

SEQ ID NO: 7982 - protein, 40 aa, Artificial Sequence
  Description of Artificial Sequence: Synthetic polypeptide
LQGFLSPLNPAHQLGNLRLEECRIMSSAKRPLWLNWENPD

SEQ ID NO: 7983 - protein, 40 aa, Artificial Sequence
  Description of Artificial Sequence: Synthetic polypeptide
LNPAHQLGNLRLEECRIMSSAKRPLWLNWENPDIMSELLF

SEQ ID NO: 7984 - protein, 40 aa, Artificial Sequence
  Description of Artificial Sequence: Synthetic polypeptide
GNLRLEECRIMSSAKRPLWLNWENPDIMSELLFQNNEIIF

SEQ ID NO: 7985 - protein, 40 aa, Artificial Sequence
  Description of Artificial Sequence: Synthetic polypeptide
RLEECRIMSSAKRPLWLNWENPDIMSELLFQNNEIIFKNG

SEQ ID NO: 7986 - protein, 40 aa, Artificial Sequence
  Description of Artificial Sequence: Synthetic polypeptide
IFKNGDDLRQDMLTLQIIRIMENIWQNQGLDLRMLPYGCL

SEQ ID NO: 7987 - protein, 40 aa, Artificial Sequence
  Description of Artificial Sequence: Synthetic polypeptide
KNGDDLRQDMLTLQIIRIMENIWQNQGLDLRMLPYGCLSI

SEQ ID NO: 7988 - protein, 40 aa, Artificial Sequence
  Description of Artificial Sequence: Synthetic polypeptide
LQIIRIMENIWQNQGLDLRMLPYGCLSIGDCVGLIEVVRN

SEQ ID NO: 7989 - protein, 40 aa, Artificial Sequence
  Description of Artificial Sequence: Synthetic polypeptide
QIIRIMENIWQNQGLDLRMLPYGCLSIGDCVGLIEVVRNS

SEQ ID NO: 7990 - protein, 40 aa, Artificial Sequence
  Description of Artificial Sequence: Synthetic polypeptide
IMENIWQNQGLDLRMLPYGCLSIGDCVGLIEVVRNSHTIM

SEQ ID NO: 7991 - protein, 40 aa, Artificial Sequence
  Description of Artificial Sequence: Synthetic polypeptide
IWQNQGLDLRMLPYGCLSIGDCVGLIEVVRNSHTIMQIQC

SEQ ID NO: 7992 - protein, 40 aa, Artificial Sequence
  Description of Artificial Sequence: Synthetic polypeptide
WQNQGLDLRMLPYGCLSIGDCVGLIEVVRNSHTIMQIQCK

SEQ ID NO: 7993 - protein, 40 aa, Artificial Sequence
  Description of Artificial Sequence: Synthetic polypeptide
QGLDLRMLPYGCLSIGDCVGLIEVVRNSHTIMQIQCKGGL

SEQ ID NO: 7994 - protein, 40 aa, Artificial Sequence
  Description of Artificial Sequence: Synthetic polypeptide
RMLPYGCLSIGDCVGLIEVVRNSHTIMQIQCKGGLKGALQ

SEQ ID NO: 7995 - protein, 40 aa, Artificial Sequence
  Description of Artificial Sequence: Synthetic polypeptide
AIDLFTRSCAGYCVATFILGIGDRHNSNIMVKDDGQLFHI

SEQ ID NO: 7996 - protein, 40 aa, Artificial Sequence
  Description of Artificial Sequence: Synthetic polypeptide
TRSCAGYCVATFILGIGDRHNSNIMVKDDGQLFHIDFGHF

SEQ ID NO: 7997 - protein, 40 aa, Artificial Sequence
  Description of Artificial Sequence: Synthetic polypeptide
TFILGIGDRHNSNIMVKDDGQLFHIDFGHFLDHKKKKFGY

SEQ ID NO: 7998 - protein, 40 aa, Artificial Sequence
  Description of Artificial Sequence: Synthetic polypeptide
GIGDRHNSNIMVKDDGQLFHIDFGHFLDHKKKKFGYKRER

SEQ ID NO: 7999 - protein, 40 aa, Artificial Sequence
  Description of Artificial Sequence: Synthetic polypeptide
IGDRHNSNIMVKDDGQLFHIDFGHFLDHKKKKFGYKRERV

SEQ ID NO: 8000 - protein, 40 aa, Artificial Sequence
  Description of Artificial Sequence: Synthetic polypeptide
HNSNIMVKDDGQLFHIDFGHFLDHKKKKFGYKRERVPFVL

SEQ ID NO: 8001 - protein, 40 aa, Artificial Sequence
  Description of Artificial Sequence: Synthetic polypeptide
MVKDDGQLFHIDFGHFLDHKKKKFGYKRERVPFVLTQDFL

SEQ ID NO: 8002 - protein, 40 aa, Artificial Sequence
  Description of Artificial Sequence: Synthetic polypeptide
DDGQLFHIDFGHFLDHKKKKFGYKRERVPFVLTQDFLIVI

SEQ ID NO: 8003 - protein, 40 aa, Artificial Sequence
  Description of Artificial Sequence: Synthetic polypeptide
DGQLFHIDFGHFLDHKKKKFGYKRERVPFVLTQDFLIVIS

SEQ ID NO: 8004 - protein, 40 aa, Artificial Sequence
  Description of Artificial Sequence: Synthetic polypeptide
GQLFHIDFGHFLDHKKKKFGYKRERVPFVLTQDFLIVISK

SEQ ID NO: 8005 - protein, 40 aa, Artificial Sequence
  Description of Artificial Sequence: Synthetic polypeptide
FHIDFGHFLDHKKKKFGYKRERVPFVLTQDFLIVISKGAQ

SEQ ID NO: 8006 - protein, 40 aa, Artificial Sequence
  Description of Artificial Sequence: Synthetic polypeptide
FGHFLDHKKKKFGYKRERVPFVLTQDFLIVISKGAQECTK

SEQ ID NO: 8007 - protein, 40 aa, Artificial Sequence
  Description of Artificial Sequence: Synthetic polypeptide
HFLDHKKKKFGYKRERVPFVLTQDFLIVISKGAQECTKTR

SEQ ID NO: 8008 - protein, 40 aa, Artificial Sequence
  Description of Artificial Sequence: Synthetic polypeptide
FLDHKKKKFGYKRERVPFVLTQDFLIVISKGAQECTKTRE

SEQ ID NO: 8009 - protein, 40 aa, Artificial Sequence
  Description of Artificial Sequence: Synthetic polypeptide
MDHKKKKFGYKRERVPFVLTQDFLIVISKGAQECTKTREF

SEQ ID NO: 8010 - protein, 40 aa, Artificial Sequence
  Description of Artificial Sequence: Synthetic polypeptide
HKKKKFGYKRERVPFVLTQDFLIVISKGAQECTKTREFER

SEQ ID NO: 8011 - protein, 40 aa, Artificial Sequence
  Description of Artificial Sequence: Synthetic polypeptide
KFGYKRERVPFVLTQDFLIVISKGAQECTKTREFERFQEM

SEQ ID NO: 8012 - protein, 40 aa, Artificial Sequence
  Description of Artificial Sequence: Synthetic polypeptide
FGYKRERVPFVLTQDFLIVISKGAQECTKTREFERFQEMC

SEQ ID NO: 8013 - protein, 40 aa, Artificial Sequence
  Description of Artificial Sequence: Synthetic polypeptide
YKRERVPFVLTQDFLIVISKGAQECTKTREFERFQEMCYK

SEQ ID NO: 8014 - protein, 40 aa, Artificial Sequence
  Description of Artificial Sequence: Synthetic polypeptide
KRERVPFVLTQDFLIVISKGAQECTKTREFERFQEMCYKA

SEQ ID NO: 8015 - protein, 40 aa, Artificial Sequence
  Description of Artificial Sequence: Synthetic polypeptide
RERVPFVLTQDFLIVISKGAQECTKTREFERFQEMCYKAY

SEQ ID NO: 8016 - protein, 40 aa, Artificial Sequence
  Description of Artificial Sequence: Synthetic polypeptide
RVPFVLTQDFLIVISKGAQECTKTREFERFQEMCYKAYLA

SEQ ID NO: 8017 - protein, 40 aa, Artificial Sequence
  Description of Artificial Sequence: Synthetic polypeptide
FVLTQDFLIVISKGAQECTKTREFERFQEMCYKAYLAIRQ

SEQ ID NO: 8018 - protein, 40 aa, Artificial Sequence
  Description of Artificial Sequence: Synthetic polypeptide
TQDFLIVISKGAQECTKTREFERFQEMCYKAYLAIRQHAN

SEQ ID NO: 8019 - protein, 40 aa, Artificial Sequence
  Description of Artificial Sequence: Synthetic polypeptide
DFLIVISKGAQECTKTREFERFQEMCYKAYLAIRQHANLF

SEQ ID NO: 8020 - protein, 40 aa, Artificial Sequence
  Description of Artificial Sequence: Synthetic polypeptide
VISKGAQECTKTREFERFQEMCYKAYLAIRQHANLFINLF

SEQ ID NO: 8021 - protein, 40 aa, Artificial Sequence
  Description of Artificial Sequence: Synthetic polypeptide
ISKGAQECTKTREFERFQEMCYKAYLAIRQHANLFINLFS

SEQ ID NO: 8022 - protein, 40 aa, Artificial Sequence
  Description of Artificial Sequence: Synthetic polypeptide
TREFERFQEMCYKAYLAIRQHANLFINLFSMMLGSGMPEL

SEQ ID NO: 8023 - protein, 40 aa, Artificial Sequence
  Description of Artificial Sequence: Synthetic polypeptide
REFERFQEMCYKAYLAIRQHANLFINLFSMMLGSGMPELQ

SEQ ID NO: 8024 - protein, 40 aa, Artificial Sequence
  Description of Artificial Sequence: Synthetic polypeptide
CYKAYLAIRQHANLFINLFSMMLGSGMPELQSFDDIAYIR

SEQ ID NO: 8025 - protein, 40 aa, Artificial Sequence
  Description of Artificial Sequence: Synthetic polypeptide
RQHANLFINLFSMMLGSGMPELQSFDDIAYIRKTLALDKT

SEQ ID NO: 8026 - protein, 40 aa, Artificial Sequence
  Description of Artificial Sequence: Synthetic polypeptide
NLFINLFSMMLGSGMPELQSFDDIAYIRKTLALDKTEQEA

SEQ ID NO: 8027 - protein, 40 aa, Artificial Sequence
  Description of Artificial Sequence: Synthetic polypeptide
LFINLFSMMLGSGMPELQSFDDIAYIRKTLALDKTEQEAL

SEQ ID NO: 8028 - protein, 40 aa, Artificial Sequence
  Description of Artificial Sequence: Synthetic polypeptide
FINLFSMMLGSGMPELQSFDDIAYIRKTLALDKTEQEALE

SEQ ID NO: 8029 - protein, 40 aa, Artificial Sequence
  Description of Artificial Sequence: Synthetic polypeptide
NLFSMMLGSGMPELQSFDDIAYIRKTLALDKTEQEALEYF

SEQ ID NO: 8030 - protein, 40 aa, Artificial Sequence
  Description of Artificial Sequence: Synthetic polypeptide
LFSMMLGSGMPELQSFDDIAYIRKTLALDKTEQEALEYFM

SEQ ID NO: 8031 - protein, 40 aa, Artificial Sequence
  Description of Artificial Sequence: Synthetic polypeptide
SMMLGSGMPELQSFDDIAYIRKTLALDKTEQEALEYFMKQ

SEQ ID NO: 8032 - protein, 40 aa, Artificial Sequence
  Description of Artificial Sequence: Synthetic polypeptide
ELQSFDDIAYIRKTLALDKTEQEALEYFMKQMNDAHHGGW

SEQ ID NO: 8033 - protein, 40 aa, Artificial Sequence
  Description of Artificial Sequence: Synthetic polypeptide
DDIAYIRKTLALDKTEQEALEYFMKQMNDAHHGGWTTKMD

SEQ ID NO: 8034 - protein, 40 aa, Artificial Sequence
  Description of Artificial Sequence: Synthetic polypeptide
RKTLALDKTEQEALEYFMKQMNDAHHGGWTTKMDWIFHTI

SEQ ID NO: 8035 - protein, 40 aa, Artificial Sequence
  Description of Artificial Sequence: Synthetic polypeptide
LALDKTEQEALEYFMKQMNDAHHGGWTTKMDWIFHTIKQH

SEQ ID NO: 8036 - protein, 40 aa, Artificial Sequence
  Description of Artificial Sequence: Synthetic polypeptide
AEGYQYRALYDYKKEREEDIDLHLGDILTVNKGSLVALGF

SEQ ID NO: 8037 - protein, 40 aa, Artificial Sequence
  Description of Artificial Sequence: Synthetic polypeptide
RALYDYKKEREEDIDLHLGDILTVNKGSLVALGFSDGQEA

SEQ ID NO: 8038 - protein, 40 aa, Artificial Sequence
  Description of Artificial Sequence: Synthetic polypeptide
ALYDYKKEREEDIDLHLGDILTVNKGSLVALGFSDGQEAR

SEQ ID NO: 8039 - protein, 40 aa, Artificial Sequence
  Description of Artificial Sequence: Synthetic polypeptide
DIDLHLGDILTVNKGSLVALGFSDGQEARPEEIGWLNGYN

SEQ ID NO: 8040 - protein, 40 aa, Artificial Sequence
  Description of Artificial Sequence: Synthetic polypeptide
GSLVALGFSDGQEARPEEIGWLNGYNETTGERGDFPGTYV

SEQ ID NO: 8041 - protein, 40 aa, Artificial Sequence
  Description of Artificial Sequence: Synthetic polypeptide
EIGWLNGYNETTGERGDFPGTYVEYIGRKKISPPTPKPRP

SEQ ID NO: 8042 - protein, 40 aa, Artificial Sequence
  Description of Artificial Sequence: Synthetic polypeptide
GWLNGYNETTGERGDFPGTYVEYIGRKKISPPTPKPRPPR

SEQ ID NO: 8043 - protein, 40 aa, Artificial Sequence
  Description of Artificial Sequence: Synthetic polypeptide
WLNGYNETTGERGDFPGTYVEYIGRKKISPPTPKPRPPRP

SEQ ID NO: 8044 - protein, 40 aa, Artificial Sequence
  Description of Artificial Sequence: Synthetic polypeptide
LNGYNETTGERGDFPGTYVEYIGRKKISPPTPKPRPPRPL

SEQ ID NO: 8045 - protein, 40 aa, Artificial Sequence
  Description of Artificial Sequence: Synthetic polypeptide
NGYNETTGERGDFPGTYVEYIGRKKISPPTPKPRPPRPLP

SEQ ID NO: 8046 - protein, 40 aa, Artificial Sequence
  Description of Artificial Sequence: Synthetic polypeptide
GYNETTGERGDFPGTYVEYIGRKKISPPTPKPRPPRPLPV

SEQ ID NO: 8047 - protein, 40 aa, Artificial Sequence
  Description of Artificial Sequence: Synthetic polypeptide
YNETTGERGDFPGTYVEYIGRKKISPPTPKPRPPRPLPVA

SEQ ID NO: 8048 - protein, 40 aa, Artificial Sequence
  Description of Artificial Sequence: Synthetic polypeptide
RGDFPGTYVEYIGRKKISPPTPKPRPPRPLPVAPGSSKTE

SEQ ID NO: 8049 - protein, 40 aa, Artificial Sequence
  Description of Artificial Sequence: Synthetic polypeptide
AEQFAPPDIAPPLLIKLVEAIEKKGLECSTLYRTQSSSNL

SEQ ID NO: 8050 - protein, 40 aa, Artificial Sequence
  Description of Artificial Sequence: Synthetic polypeptide
EQFAPPDIAPPLLIKLVEAIEKKGLECSTLYRTQSSSNLA

SEQ ID NO: 8051 - protein, 40 aa, Artificial Sequence
  Description of Artificial Sequence: Synthetic polypeptide
APPDIAPPLLIKLVEAIEKKGLECSTLYRTQSSSNLAELR

SEQ ID NO: 8052 - protein, 40 aa, Artificial Sequence
  Description of Artificial Sequence: Synthetic polypeptide
SNLAELRQLLDCDTPSVDLEMIDVHVLADAFKRYLLDLPN

SEQ ID NO: 8053 - protein, 40 aa, Artificial Sequence
  Description of Artificial Sequence: Synthetic polypeptide
LLDCDTPSVDLEMIDVHVLADAFKRYLLDLPNPVIPAAVY

SEQ ID NO: 8054 - protein, 40 aa, Artificial Sequence
  Description of Artificial Sequence: Synthetic polypeptide
DAFKRYLLDLPNPVIPAAVYSEMISLAPEVQSSEEYIQLL

SEQ ID NO: 8055 - protein, 40 aa, Artificial Sequence
  Description of Artificial Sequence: Synthetic polypeptide
LLDLPNPVIPAAVYSEMISLAPEVQSSEEYIQLLKKLIRS

SEQ ID NO: 8056 - protein, 40 aa, Artificial Sequence
  Description of Artificial Sequence: Synthetic polypeptide
MDLPNPVIPAAVYSEMISLAPEVQSSEEYIQLLKKLIRSP

SEQ ID NO: 8057 - protein, 40 aa, Artificial Sequence
  Description of Artificial Sequence: Synthetic polypeptide
DLPNPVIPAAVYSEMISLAPEVQSSEEYIQLLKKLIRSPS

SEQ ID NO: 8058 - protein, 40 aa, Artificial Sequence
  Description of Artificial Sequence: Synthetic polypeptide
PNPVIPAAVYSEMISLAPEVQSSEEYIQLLKKLIRSPSIP

SEQ ID NO: 8059 - protein, 40 aa, Artificial Sequence
  Description of Artificial Sequence: Synthetic polypeptide
NPVIPAAVYSEMISLAPEVQSSEEYIQLLKKLIRSPSIPH

SEQ ID NO: 8060 - protein, 40 aa, Artificial Sequence
  Description of Artificial Sequence: Synthetic polypeptide
AVYSEMISLAPEVQSSEEYIQLLKKLIRSPSIPHQYWLTL

SEQ ID NO: 8061 - protein, 40 aa, Artificial Sequence
  Description of Artificial Sequence: Synthetic polypeptide
ISLAPEVQSSEEYIQLLKKLIRSPSIPHQYWLTLQYLLKH

SEQ ID NO: 8062 - protein, 40 aa, Artificial Sequence
  Description of Artificial Sequence: Synthetic polypeptide
SLAPEVQSSEEYIQLLKKLIRSPSIPHQYWLTLQYLLKHF

SEQ ID NO: 8063 - protein, 40 aa, Artificial Sequence
  Description of Artificial Sequence: Synthetic polypeptide
VQSSEEYIQLLKKLIRSPSIPHQYWLTLQYLLKHFFKLSQ

SEQ ID NO: 8064 - protein, 40 aa, Artificial Sequence
  Description of Artificial Sequence: Synthetic polypeptide
SSEEYIQLLKKLIRSPSIPHQYWLTLQYLLKHFFKLSQTS

SEQ ID NO: 8065 - protein, 40 aa, Artificial Sequence
  Description of Artificial Sequence: Synthetic polypeptide
LLKKLIRSPSIPHQYWLTLQYLLKHFFKLSQTSSKNLLNA

SEQ ID NO: 8066 - protein, 40 aa, Artificial Sequence
  Description of Artificial Sequence: Synthetic polypeptide
IRSPSIPHQYWLTLQYLLKHFFKLSQTSSKNLLNARVLSE

SEQ ID NO: 8067 - protein, 40 aa, Artificial Sequence
  Description of Artificial Sequence: Synthetic polypeptide
IPHQYWLTLQYLLKHFFKLSQTSSKNLLNARVLSEIFSPM

SEQ ID NO: 8068 - protein, 40 aa, Artificial Sequence
  Description of Artificial Sequence: Synthetic polypeptide
HQYWLTLQYLLKHFFKLSQTSSKNLLNARVLSEIFSPMLF

SEQ ID NO: 8069 - protein, 40 aa, Artificial Sequence
  Description of Artificial Sequence: Synthetic polypeptide
QYWLTLQYLLKHFFKLSQTSSKNLLNARVLSEIFSPMLFR

SEQ ID NO: 8070 - protein, 40 aa, Artificial Sequence
  Description of Artificial Sequence: Synthetic polypeptide
YWLTLQYLLKHFFKLSQTSSKNLLNARVLSEIFSPMLFRF

SEQ ID NO: 8071 - protein, 40 aa, Artificial Sequence
  Description of Artificial Sequence: Synthetic polypeptide
TLQYLLKHFFKLSQTSSKNLLNARVLSEIFSPMLFRFSAA

SEQ ID NO: 8072 - protein, 40 aa, Artificial Sequence
  Description of Artificial Sequence: Synthetic polypeptide
LQYLLKHFFKLSQTSSKNLLNARVLSEIFSPMLFRFSAAS

SEQ ID NO: 8073 - protein, 40 aa, Artificial Sequence
  Description of Artificial Sequence: Synthetic polypeptide
QYLLKHFFKLSQTSSKNLLNARVLSEIFSPMLFRFSAASS

SEQ ID NO: 8074 - protein, 40 aa, Artificial Sequence
  Description of Artificial Sequence: Synthetic polypeptide
YLLKHFFKLSQTSSKNLLNARVLSEIFSPMLFRFSAASSD

SEQ ID NO: 8075 - protein, 40 aa, Artificial Sequence
  Description of Artificial Sequence: Synthetic polypeptide
MLKHFFKLSQTSSKNLLNARVLSEIFSPMLFRFSAASSDN

SEQ ID NO: 8076 - protein, 40 aa, Artificial Sequence
  Description of Artificial Sequence: Synthetic polypeptide
HFFKLSQTSSKNLLNARVLSEIFSPMLFRFSAASSDNTEN

SEQ ID NO: 8077 - protein, 40 aa, Artificial Sequence
  Description of Artificial Sequence: Synthetic polypeptide
SQTSSKNLLNARVLSEIFSPMLFRFSAASSDNTENLIKVI

SEQ ID NO: 8078 - protein, 40 aa, Artificial Sequence
  Description of Artificial Sequence: Synthetic polypeptide
QTSSKNLLNARVLSEIFSPMLFRFSAASSDNTENLIKVIE

SEQ ID NO: 8079 - protein, 40 aa, Artificial Sequence
  Description of Artificial Sequence: Synthetic polypeptide
TSSKNLLNARVLSEIFSPMLFRFSAASSDNTENLIKVIEI

SEQ ID NO: 8080 - protein, 40 aa, Artificial Sequence
  Description of Artificial Sequence: Synthetic polypeptide
SSKNLLNARVLSEIFSPMLFRFSAASSDNTENLIKVIEIL

SEQ ID NO: 8081 - protein, 40 aa, Artificial Sequence
  Description of Artificial Sequence: Synthetic polypeptide
NLLNARVLSEIFSPMLFRFSAASSDNTENLIKVIEILIST

SEQ ID NO: 8082 - protein, 40 aa, Artificial Sequence
  Description of Artificial Sequence: Synthetic polypeptide
MLNARVLSEIFSPMLFRFSAASSDNTENLIKVIEILISTE

SEQ ID NO: 8083 - protein, 40 aa, Artificial Sequence
  Description of Artificial Sequence: Synthetic polypeptide
MNARVLSEIFSPMLFRFSAASSDNTENLIKVIEILISTEW

SEQ ID NO: 8084 - protein, 40 aa, Artificial Sequence
  Description of Artificial Sequence: Synthetic polypeptide
RVLSEIFSPMLFRFSAASSDNTENLIKVIEILISTEWNER

SEQ ID NO: 8085 - protein, 40 aa, Artificial Sequence
  Description of Artificial Sequence: Synthetic polypeptide
LSEIFSPMLFRFSAASSDNTENLIKVIEILISTEWNERQP

SEQ ID NO: 8086 - protein, 40 aa, Artificial Sequence
  Description of Artificial Sequence: Synthetic polypeptide
EIFSPMLFRFSAASSDNTENLIKVIEILISTEWNERQPAP

SEQ ID NO: 8087 - protein, 40 aa, Artificial Sequence
  Description of Artificial Sequence: Synthetic polypeptide
IFSPMLFRFSAASSDNTENLIKVIEILISTEWNERQPAPA

SEQ ID NO: 8088 - protein, 40 aa, Artificial Sequence
  Description of Artificial Sequence: Synthetic polypeptide
SPMLFRFSAASSDNTENLIKVIEILISTEWNERQPAPALP

SEQ ID NO: 8089 - protein, 40 aa, Artificial Sequence
  Description of Artificial Sequence: Synthetic polypeptide
LFRFSAASSDNTENLIKVIEILISTEWNERQPAPALPPKP

SEQ ID NO: 8090 - protein, 40 aa, Artificial Sequence
  Description of Artificial Sequence: Synthetic polypeptide
RFSAASSDNTENLIKVIEILISTEWNERQPAPALPPKPPK

SEQ ID NO: 8091 - protein, 40 aa, Artificial Sequence
  Description of Artificial Sequence: Synthetic polypeptide
AASSDNTENLIKVIEILISTEWNERQPAPALPPKPPKPTT

SEQ ID NO: 8092 - protein, 40 aa, Artificial Sequence
  Description of Artificial Sequence: Synthetic polypeptide
ASSDNTENLIKVIEILISTEWNERQPAPALPPKPPKPTTV

SEQ ID NO: 8093 - protein, 40 aa, Artificial Sequence
  Description of Artificial Sequence: Synthetic polypeptide
SSDNTENLIKVIEILISTEWNERQPAPALPPKPPKPTTVA

SEQ ID NO: 8094 - protein, 40 aa, Artificial Sequence
  Description of Artificial Sequence: Synthetic polypeptide
SDNTENLIKVIEILISTEWNERQPAPALPPKPPKPTTVAN

SEQ ID NO: 8095 - protein, 40 aa, Artificial Sequence
  Description of Artificial Sequence: Synthetic polypeptide
DNTENLIKVIEILISTEWNERQPAPALPPKPPKPTTVANN

SEQ ID NO: 8096 - protein, 40 aa, Artificial Sequence
  Description of Artificial Sequence: Synthetic polypeptide
PPKPPKPTTVANNGMNNNMSLQDAEWYWGDISREEVNEKL

SEQ ID NO: 8097 - protein, 40 aa, Artificial Sequence
  Description of Artificial Sequence: Synthetic polypeptide
DAEWYWGDISREEVNEKLRDTADGTFLVRDASTKMHGDYT

SEQ ID NO: 8098 - protein, 40 aa, Artificial Sequence
  Description of Artificial Sequence: Synthetic polypeptide
YWGDISREEVNEKLRDTADGTFLVRDASTKMHGDYTLTLR

SEQ ID NO: 8099 - protein, 40 aa, Artificial Sequence
  Description of Artificial Sequence: Synthetic polypeptide
EKLRDTADGTFLVRDASTKMHGDYTLTLRKGGNNKLIKIF

SEQ ID NO: 8100 - protein, 40 aa, Artificial Sequence
  Description of Artificial Sequence: Synthetic polypeptide
LRDTADGTFLVRDASTKMHGDYTLTLRKGGNNKLIKIFHR

SEQ ID NO: 8101 - protein, 40 aa, Artificial Sequence
  Description of Artificial Sequence: Synthetic polypeptide
DTADGTFLVRDASTKMHGDYTLTLRKGGNNKLIKIFHRDG

SEQ ID NO: 8102 - protein, 40 aa, Artificial Sequence
  Description of Artificial Sequence: Synthetic polypeptide
DGTFLVRDASTKMHGDYTLTLRKGGNNKLIKIFHRDGKYG

SEQ ID NO: 8103 - protein, 40 aa, Artificial Sequence
  Description of Artificial Sequence: Synthetic polypeptide
VRDASTKMHGDYTLTLRKGGNNKLIKIFHRDGKYGFSDPL

SEQ ID NO: 8104 - protein, 40 aa, Artificial Sequence
  Description of Artificial Sequence: Synthetic polypeptide
ASTKMHGDYTLTLRKGGNNKLIKIFHRDGKYGFSDPLTFS

SEQ ID NO: 8105 - protein, 40 aa, Artificial Sequence
  Description of Artificial Sequence: Synthetic polypeptide
MHGDYTLTLRKGGNNKLIKIFHRDGKYGFSDPLTFSSVVE

SEQ ID NO: 8106 - protein, 40 aa, Artificial Sequence
  Description of Artificial Sequence: Synthetic polypeptide
DYTLTLRKGGNNKLIKIFHRDGKYGFSDPLTFSSVVELIN

SEQ ID NO: 8107 - protein, 40 aa, Artificial Sequence
  Description of Artificial Sequence: Synthetic polypeptide
LTLRKGGNNKLIKIFHRDGKYGFSDPLTFSSVVELINHYR

SEQ ID NO: 8108 - protein, 40 aa, Artificial Sequence
  Description of Artificial Sequence: Synthetic polypeptide
NNKLIKIFHRDGKYGFSDPLTFSSVVELINHYRNESLAQY

SEQ ID NO: 8109 - protein, 40 aa, Artificial Sequence
  Description of Artificial Sequence: Synthetic polypeptide
LIKIFHRDGKYGFSDPLTFSSVVELINHYRNESLAQYNPK

SEQ ID NO: 8110 - protein, 40 aa, Artificial Sequence
  Description of Artificial Sequence: Synthetic polypeptide
RDGKYGFSDPLTFSSVVELINHYRNESLAQYNPKLDVKLL

SEQ ID NO: 8111 - protein, 40 aa, Artificial Sequence
  Description of Artificial Sequence: Synthetic polypeptide
DGKYGFSDPLTFSSVVELINHYRNESLAQYNPKLDVKLLY

SEQ ID NO: 8112 - protein, 40 aa, Artificial Sequence
  Description of Artificial Sequence: Synthetic polypeptide
DPLTFSSVVELINHYRNESLAQYNPKLDVKLLYPVSKYQQ

SEQ ID NO: 8113 - protein, 40 aa, Artificial Sequence
  Description of Artificial Sequence: Synthetic polypeptide
PLTFSSVVELINHYRNESLAQYNPKLDVKLLYPVSKYQQD

SEQ ID NO: 8114 - protein, 40 aa, Artificial Sequence
  Description of Artificial Sequence: Synthetic polypeptide
SVVELINHYRNESLAQYNPKLDVKLLYPVSKYQQDQVVKE

SEQ ID NO: 8115 - protein, 40 aa, Artificial Sequence
  Description of Artificial Sequence: Synthetic polypeptide
VELINHYRNESLAQYNPKLDVKLLYPVSKYQQDQVVKEDN

SEQ ID NO: 8116 - protein, 40 aa, Artificial Sequence
  Description of Artificial Sequence: Synthetic polypeptide
ELINHYRNESLAQYNPKLDVKLLYPVSKYQQDQVVKEDNI

SEQ ID NO: 8117 - protein, 40 aa, Artificial Sequence
  Description of Artificial Sequence: Synthetic polypeptide
HYRNESLAQYNPKLDVKLLYPVSKYQQDQVVKEDNIEAVG

SEQ ID NO: 8118 - protein, 40 aa, Artificial Sequence
  Description of Artificial Sequence: Synthetic polypeptide
NESLAQYNPKLDVKLLYPVSKYQQDQVVKEDNIEAVGKKL

SEQ ID NO: 8119 - protein, 40 aa, Artificial Sequence
  Description of Artificial Sequence: Synthetic polypeptide
YNPKLDVKLLYPVSKYQQDQVVKEDNIEAVGKKLHEYNTQ

SEQ ID NO: 8120 - protein, 40 aa, Artificial Sequence
  Description of Artificial Sequence: Synthetic polypeptide
PKLDVKLLYPVSKYQQDQVVKEDNIEAVGKKLHEYNTQFQ

SEQ ID NO: 8121 - protein, 40 aa, Artificial Sequence
  Description of Artificial Sequence: Synthetic polypeptide
VKLLYPVSKYQQDQVVKEDNIEAVGKKLHEYNTQFQEKSR

SEQ ID NO: 8122 - protein, 40 aa, Artificial Sequence
  Description of Artificial Sequence: Synthetic polypeptide
LYPVSKYQQDQVVKEDNIEAVGKKLHEYNTQFQEKSREYD

SEQ ID NO: 8123 - protein, 40 aa, Artificial Sequence
  Description of Artificial Sequence: Synthetic polypeptide
VSKYQQDQVVKEDNIEAVGKKLHEYNTQFQEKSREYDRLY

SEQ ID NO: 8124 - protein, 40 aa, Artificial Sequence
  Description of Artificial Sequence: Synthetic polypeptide
YQQDQVVKEDNIEAVGKKLHEYNTQFQEKSREYDRLYEEY

SEQ ID NO: 8125 - protein, 40 aa, Artificial Sequence
  Description of Artificial Sequence: Synthetic polypeptide
VVKEDNIEAVGKKLHEYNTQFQEKSREYDRLYEEYTRTSQ

SEQ ID NO: 8126 - protein, 40 aa, Artificial Sequence
  Description of Artificial Sequence: Synthetic polypeptide
DNIEAVGKKLHEYNTQFQEKSREYDRLYEEYTRTSQEIQM

SEQ ID NO: 8127 - protein, 40 aa, Artificial Sequence
  Description of Artificial Sequence: Synthetic polypeptide
AVGKKLHEYNTQFQEKSREYDRLYEEYTRTSQEIQMKRTA

SEQ ID NO: 8128 - protein, 40 aa, Artificial Sequence
  Description of Artificial Sequence: Synthetic polypeptide
GKKLHEYNTQFQEKSREYDRLYEEYTRTSQEIQMKRTAIE

SEQ ID NO: 8129 - protein, 40 aa, Artificial Sequence
  Description of Artificial Sequence: Synthetic polypeptide
KKLHEYNTQFQEKSREYDRLYEEYTRTSQEIQMKRTAIEA

SEQ ID NO: 8130 - protein, 40 aa, Artificial Sequence
  Description of Artificial Sequence: Synthetic polypeptide
KLHEYNTQFQEKSREYDRLYEEYTRTSQEIQMKRTAIEAF

SEQ ID NO: 8131 - protein, 40 aa, Artificial Sequence
  Description of Artificial Sequence: Synthetic polypeptide
LHEYNTQFQEKSREYDRLYEEYTRTSQEIQMKRTAIEAFN

SEQ ID NO: 8132 - protein, 40 aa, Artificial Sequence
  Description of Artificial Sequence: Synthetic polypeptide
HEYNTQFQEKSREYDRLYEEYTRTSQEIQMKRTAIEAFNE

SEQ ID NO: 8133 - protein, 40 aa, Artificial Sequence
  Description of Artificial Sequence: Synthetic polypeptide
EYNTQFQEKSREYDRLYEEYTRTSQEIQMKRTAIEAFNET

SEQ ID NO: 8134 - protein, 40 aa, Artificial Sequence
  Description of Artificial Sequence: Synthetic polypeptide
YNTQFQEKSREYDRLYEEYTRTSQEIQMKRTAIEAFNETI

SEQ ID NO: 8135 - protein, 40 aa, Artificial Sequence
  Description of Artificial Sequence: Synthetic polypeptide
TQFQEKSREYDRLYEEYTRTSQEIQMKRTAIEAFNETIKI

SEQ ID NO: 8136 - protein, 40 aa, Artificial Sequence
  Description of Artificial Sequence: Synthetic polypeptide
FQEKSREYDRLYEEYTRTSQEIQMKRTAIEAFNETIKIFE

SEQ ID NO: 8137 - protein, 40 aa, Artificial Sequence
  Description of Artificial Sequence: Synthetic polypeptide
RLYEEYTRTSQEIQMKRTAIEAFNETIKIFEEQCQTQERY

SEQ ID NO: 8138 - protein, 40 aa, Artificial Sequence
  Description of Artificial Sequence: Synthetic polypeptide
LYEEYTRTSQEIQMKRTAIEAFNETIKIFEEQCQTQERYS

SEQ ID NO: 8139 - protein, 40 aa, Artificial Sequence
  Description of Artificial Sequence: Synthetic polypeptide
RTSQEIQMKRTAIEAFNETIKIFEEQCQTQERYSKEYIEK

SEQ ID NO: 8140 - protein, 40 aa, Artificial Sequence
  Description of Artificial Sequence: Synthetic polypeptide
QEIQMKRTAIEAFNETIKIFEEQCQTQERYSKEYIEKFKR

SEQ ID NO: 8141 - protein, 40 aa, Artificial Sequence
  Description of Artificial Sequence: Synthetic polypeptide
EIQMKRTAIEAFNETIKIFEEQCQTQERYSKEYIEKFKRE

SEQ ID NO: 8142 - protein, 40 aa, Artificial Sequence
  Description of Artificial Sequence: Synthetic polypeptide
QMKRTAIEAFNETIKIFEEQCQTQERYSKEYIEKFKREGN

SEQ ID NO: 8143 - protein, 40 aa, Artificial Sequence
  Description of Artificial Sequence: Synthetic polypeptide
EAFNETIKIFEEQCQTQERYSKEYIEKFKREGNEKEIQRI

SEQ ID NO: 8144 - protein, 40 aa, Artificial Sequence
  Description of Artificial Sequence: Synthetic polypeptide
ETIKIFEEQCQTQERYSKEYIEKFKREGNEKEIQRIMHNY

SEQ ID NO: 8145 - protein, 40 aa, Artificial Sequence
  Description of Artificial Sequence: Synthetic polypeptide
ERYSKEYIEKFKREGNEKEIQRIMHNYDKLKSRISEIIDS

SEQ ID NO: 8146 - protein, 40 aa, Artificial Sequence
  Description of Artificial Sequence: Synthetic polypeptide
RYSKEYIEKFKREGNEKEIQRIMHNYDKLKSRISEIIDSR

SEQ ID NO: 8147 - protein, 40 aa, Artificial Sequence
  Description of Artificial Sequence: Synthetic polypeptide
SKEYIEKFKREGNEKEIQRIMHNYDKLKSRISEIIDSRRR

SEQ ID NO: 8148 - protein, 40 aa, Artificial Sequence
  Description of Artificial Sequence: Synthetic polypeptide
KEYIEKFKREGNEKEIQRIMHNYDKLKSRISEIIDSRRRL

SEQ ID NO: 8149 - protein, 40 aa, Artificial Sequence
  Description of Artificial Sequence: Synthetic polypeptide
YIEKFKREGNEKEIQRIMHNYDKLKSRISEIIDSRRRLEE

SEQ ID NO: 8150 - protein, 40 aa, Artificial Sequence
  Description of Artificial Sequence: Synthetic polypeptide
IEKFKREGNEKEIQRIMHNYDKLKSRISEIIDSRRRLEED

SEQ ID NO: 8151 - protein, 40 aa, Artificial Sequence
  Description of Artificial Sequence: Synthetic polypeptide
KREGNEKEIQRIMHNYDKLKSRISEIIDSRRRLEEDLKKQ

SEQ ID NO: 8152 - protein, 40 aa, Artificial Sequence
  Description of Artificial Sequence: Synthetic polypeptide
EGNEKEIQRIMHNYDKLKSRISEIIDSRRRLEEDLKKQAA

SEQ ID NO: 8153 - protein, 40 aa, Artificial Sequence
  Description of Artificial Sequence: Synthetic polypeptide
EKEIQRIMHNYDKLKSRISEIIDSRRRLEEDLKKQAAEYR

SEQ ID NO: 8154 - protein, 40 aa, Artificial Sequence
  Description of Artificial Sequence: Synthetic polypeptide
KEIQRIMHNYDKLKSRISEIIDSRRRLEEDLKKQAAEYRE

SEQ ID NO: 8155 - protein, 40 aa, Artificial Sequence
  Description of Artificial Sequence: Synthetic polypeptide
IQRIMHNYDKLKSRISEIIDSRRRLEEDLKKQAAEYREID

SEQ ID NO: 8156 - protein, 40 aa, Artificial Sequence
  Description of Artificial Sequence: Synthetic polypeptide
QRIMHNYDKLKSRISEIIDSRRRLEEDLKKQAAEYREIDK

SEQ ID NO: 8157 - protein, 40 aa, Artificial Sequence
  Description of Artificial Sequence: Synthetic polypeptide
RIMHNYDKLKSRISEIIDSRRRLEEDLKKQAAEYREIDKR

SEQ ID NO: 8158 - protein, 40 aa, Artificial Sequence
  Description of Artificial Sequence: Synthetic polypeptide
IMHNYDKLKSRISEIIDSRRRLEEDLKKQAAEYREIDKRM

SEQ ID NO: 8159 - protein, 40 aa, Artificial Sequence
  Description of Artificial Sequence: Synthetic polypeptide
NYDKLKSRISEIIDSRRRLEEDLKKQAAEYREIDKRMNSI

SEQ ID NO: 8160 - protein, 40 aa, Artificial Sequence
  Description of Artificial Sequence: Synthetic polypeptide
SRISEIIDSRRRLEEDLKKQAAEYREIDKRMNSIKPDLIQ

SEQ ID NO: 8161 - protein, 40 aa, Artificial Sequence
  Description of Artificial Sequence: Synthetic polypeptide
RISEIIDSRRRLEEDLKKQAAEYREIDKRMNSIKPDLIQL

SEQ ID NO: 8162 - protein, 40 aa, Artificial Sequence
  Description of Artificial Sequence: Synthetic polypeptide
EIIDSRRRLEEDLKKQAAEYREIDKRMNSIKPDLIQLRKT

SEQ ID NO: 8163 - protein, 40 aa, Artificial Sequence
  Description of Artificial Sequence: Synthetic polypeptide
IDSRRRLEEDLKKQAAEYREIDKRMNSIKPDLIQLRKTRD

SEQ ID NO: 8164 - protein, 40 aa, Artificial Sequence
  Description of Artificial Sequence: Synthetic polypeptide
SRRRLEEDLKKQAAEYREIDKRMNSIKPDLIQLRKTRDQY

SEQ ID NO: 8165 - protein, 40 aa, Artificial Sequence
  Description of Artificial Sequence: Synthetic polypeptide
RLEEDLKKQAAEYREIDKRMNSIKPDLIQLRKTRDQYLMW

SEQ ID NO: 8166 - protein, 40 aa, Artificial Sequence
  Description of Artificial Sequence: Synthetic polypeptide
VRQKKLNEWLGNENTEDQYSLVEDDEDLPHHDEKTWNVGS

SEQ ID NO: 8167 - protein, 40 aa, Artificial Sequence
  Description of Artificial Sequence: Synthetic polypeptide
WLGNENTEDQYSLVEDDEDLPHHDEKTWNVGSSNRNKAEN

SEQ ID NO: 8168 - protein, 40 aa, Artificial Sequence
  Description of Artificial Sequence: Synthetic polypeptide
VRESSKQGCYACSVVVDGEVKHCVINKTATGYGFAEPYNL

SEQ ID NO: 8169 - protein, 40 aa, Artificial Sequence
  Description of Artificial Sequence: Synthetic polypeptide
SSKQGCYACSVVVDGEVKHCVINKTATGYGFAEPYNLYSS

SEQ ID NO: 8170 - protein, 40 aa, Artificial Sequence
  Description of Artificial Sequence: Synthetic polypeptide
SKQGCYACSVVVDGEVKHCVINKTATGYGFAEPYNLYSSL

SEQ ID NO: 8171 - protein, 40 aa, Artificial Sequence
  Description of Artificial Sequence: Synthetic polypeptide
KQGCYACSVVVDGEVKHCVINKTATGYGFAEPYNLYSSLK

SEQ ID NO: 8172 - protein, 40 aa, Artificial Sequence
  Description of Artificial Sequence: Synthetic polypeptide
QGCYACSVVVDGEVKHCVINKTATGYGFAEPYNLYSSLKE

SEQ ID NO: 8173 - protein, 40 aa, Artificial Sequence
  Description of Artificial Sequence: Synthetic polypeptide
VVVDGEVKHCVINKTATGYGFAEPYNLYSSLKELVLHYQH

SEQ ID NO: 8174 - protein, 40 aa, Artificial Sequence
  Description of Artificial Sequence: Synthetic polypeptide
DGEVKHCVINKTATGYGFAEPYNLYSSLKELVLHYQHTSL

SEQ ID NO: 8175 - protein, 40 aa, Artificial Sequence
  Description of Artificial Sequence: Synthetic polypeptide
VKHCVINKTATGYGFAEPYNLYSSLKELVLHYQHTSLVQH

SEQ ID NO: 8176 - protein, 40 aa, Artificial Sequence
  Description of Artificial Sequence: Synthetic polypeptide
HCVINKTATGYGFAEPYNLYSSLKELVLHYQHTSLVQHND

SEQ ID NO: 8177 - protein, 40 aa, Artificial Sequence
  Description of Artificial Sequence: Synthetic polypeptide
TATGYGFAEPYNLYSSLKELVLHYQHTSLVQHNDSLNVTL

SEQ ID NO: 8178 - protein, 40 aa, Artificial Sequence
  Description of Artificial Sequence: Synthetic polypeptide
YGFAEPYNLYSSLKELVLHYQHTSLVQHNDSLNVTLAYPV

SEQ ID NO: 8179 - protein, 40 aa, Artificial Sequence
  Description of Artificial Sequence: Synthetic polypeptide
FAEPYNLYSSLKELVLHYQHTSLVQHNDSLNVTLAYPVYA

SEQ ID NO: 8180 - protein, 40 aa, Artificial Sequence
  Description of Artificial Sequence: Synthetic polypeptide
YNLYSSLKELVLHYQHTSLVQHNDSLNVTLAYPVYAQQRR

SEQ ID NO: 8181 - protein, 40 aa, Artificial Sequence
  Description of Artificial Sequence: Synthetic polypeptide
RAISHEHSPSDLEAHFVPLVKRLAGGDWFTSRTSACGLFS

SEQ ID NO: 8182 - protein, 40 aa, Artificial Sequence
  Description of Artificial Sequence: Synthetic polypeptide
SHEHSPSDLEAHFVPLVKRLAGGDWFTSRTSACGLFSVCY

SEQ ID NO: 8183 - protein, 40 aa, Artificial Sequence
  Description of Artificial Sequence: Synthetic polypeptide
SPSDLEAHFVPLVKRLAGGDWFTSRTSACGLFSVCYPRVS

SEQ ID NO: 8184 - protein, 40 aa, Artificial Sequence
  Description of Artificial Sequence: Synthetic polypeptide
PSDLEAHFVPLVKRLAGGDWFTSRTSACGLFSVCYPRVSS

SEQ ID NO: 8185 - protein, 40 aa, Artificial Sequence
  Description of Artificial Sequence: Synthetic polypeptide
SDLEAHFVPLVKRLAGGDWFTSRTSACGLFSVCYPRVSSA

SEQ ID NO: 8186 - protein, 40 aa, Artificial Sequence
  Description of Artificial Sequence: Synthetic polypeptide
LVKRLAGGDWFTSRTSACGLFSVCYPRVSSAVKAELRQYF

SEQ ID NO: 8187 - protein, 40 aa, Artificial Sequence
  Description of Artificial Sequence: Synthetic polypeptide
VKRLAGGDWFTSRTSACGLFSVCYPRVSSAVKAELRQYFR

SEQ ID NO: 8188 - protein, 40 aa, Artificial Sequence
  Description of Artificial Sequence: Synthetic polypeptide
WFTSRTSACGLFSVCYPRVSSAVKAELRQYFRNLCSDDTP

SEQ ID NO: 8189 - protein, 40 aa, Artificial Sequence
  Description of Artificial Sequence: Synthetic polypeptide
MEALVMPTLRQAAEDKSWRVRYMVADKFTELQKAVGPEIT

SEQ ID NO: 8190 - protein, 40 aa, Artificial Sequence
  Description of Artificial Sequence: Synthetic polypeptide
EITKTDLVPAFQNLMKDCEAEVRAAASHKVKEFCENLSAD

SEQ ID NO: 8191 - protein, 40 aa, Artificial Sequence
  Description of Artificial Sequence: Synthetic polypeptide
KVKEFCENLSADCRENVIMSQILPCIKELVSDANQHVKSA

SEQ ID NO: 8192 - protein, 40 aa, Artificial Sequence
  Description of Artificial Sequence: Synthetic polypeptide
NTIEHLLPLFLAQLKDECPEVRLNIISNLDCVNEVIGIRQ

SEQ ID NO: 8193 - protein, 40 aa, Artificial Sequence
  Description of Artificial Sequence: Synthetic polypeptide
QLKDECPEVRLNIISNLDCVNEVIGIRQLSQSLLPAIVEL

SEQ ID NO: 8194 - protein, 40 aa, Artificial Sequence
  Description of Artificial Sequence: Synthetic polypeptide
MSQSLLPAIVELAEDAKWRVRLAIIEYMPLLAGQLGVEFF

SEQ ID NO: 8195 - protein, 40 aa, Artificial Sequence
  Description of Artificial Sequence: Synthetic polypeptide
ELAEDAKWRVRLAIIEYMPLLAGQLGVEFFDEKLNSLCMA

SEQ ID NO: 8196 - protein, 40 aa, Artificial Sequence
  Description of Artificial Sequence: Synthetic polypeptide
AIIEYMPLLAGQLGVEFFDEKLNSLCMAWLVDHVYAIREA

SEQ ID NO: 8197 - protein, 40 aa, Artificial Sequence
  Description of Artificial Sequence: Synthetic polypeptide
QLGVEFFDEKLNSLCMAWLVDHVYAIREAATSNLKKLVEK

SEQ ID NO: 8198 - protein, 40 aa, Artificial Sequence
  Description of Artificial Sequence: Synthetic polypeptide
FGKEWAHATIIPKVLAMSGDPNYLHRMTTLFCINVLSEVC

SEQ ID NO: 8199 - protein, 40 aa, Artificial Sequence
  Description of Artificial Sequence: Synthetic polypeptide
VLAMSGDPNYLHRMTTLFCINVLSEVCGQDITTKHMLPTV

SEQ ID NO: 8200 - protein, 40 aa, Artificial Sequence
  Description of Artificial Sequence: Synthetic polypeptide
HMLPTVLRMAGDPVANVRFNVAKSLQKIGPILDNSTLQSE

SEQ ID NO: 8201 - protein, 40 aa, Artificial Sequence
  Description of Artificial Sequence: Synthetic polypeptide
RFNVAKSLQKIGPILDNSTLQSEVKPILEKLTQDQDVDVK

SEQ ID NO: 8202 - protein, 40 aa, Artificial Sequence
  Description of Artificial Sequence: Synthetic polypeptide
TGVEAENLLLTRGVDGSFLARPSKSNPGDFTLSVRRNGAV

SEQ ID NO: 8203 - protein, 40 aa, Artificial Sequence
  Description of Artificial Sequence: Synthetic polypeptide
EAENLLLTRGVDGSFLARPSKSNPGDFTLSVRRNGAVTHI

SEQ ID NO: 8204 - protein, 40 aa, Artificial Sequence
  Description of Artificial Sequence: Synthetic polypeptide
AENLLLTRGVDGSFLARPSKSNPGDFTLSVRRNGAVTHIK

SEQ ID NO: 8205 - protein, 40 aa, Artificial Sequence
  Description of Artificial Sequence: Synthetic polypeptide
NLLLTRGVDGSFLARPSKSNPGDFTLSVRRNGAVTHIKIQ

SEQ ID NO: 8206 - protein, 40 aa, Artificial Sequence
  Description of Artificial Sequence: Synthetic polypeptide
GSFLARPSKSNPGDFTLSVRRNGAVTHIKIQNTGDYYDLY

SEQ ID NO: 8207 - protein, 40 aa, Artificial Sequence
  Description of Artificial Sequence: Synthetic polypeptide
SVRRNGAVTHIKIQNTGDYYDLYGGEKFATLAELVQYYME

SEQ ID NO: 8208 - protein, 40 aa, Artificial Sequence
  Description of Artificial Sequence: Synthetic polypeptide
RNGAVTHIKIQNTGDYYDLYGGEKFATLAELVQYYMEHHG

SEQ ID NO: 8209 - protein, 40 aa, Artificial Sequence
  Description of Artificial Sequence: Synthetic polypeptide
YYDLYGGEKFATLAELVQYYMEHHGQLKEKNGDVIELKYP

SEQ ID NO: 8210 - protein, 40 aa, Artificial Sequence
  Description of Artificial Sequence: Synthetic polypeptide
GGEKFATLAELVQYYMEHHGQLKEKNGDVIELKYPLNCAD

SEQ ID NO: 8211 - protein, 40 aa, Artificial Sequence
  Description of Artificial Sequence: Synthetic polypeptide
YPLNCADPTSERWFHGHLSGKEAEKLLTEKGKHGSFLVRE

SEQ ID NO: 8212 - protein, 40 aa, Artificial Sequence
  Description of Artificial Sequence: Synthetic polypeptide
CADPTSERWFHGHLSGKEAEKLLTEKGKHGSFLVRESQSH

SEQ ID NO: 8213 - protein, 40 aa, Artificial Sequence
  Description of Artificial Sequence: Synthetic polypeptide
ADPTSERWFHGHLSGKEAEKLLTEKGKHGSFLVRESQSHP

SEQ ID NO: 8214 - protein, 40 aa, Artificial Sequence
  Description of Artificial Sequence: Synthetic polypeptide
TSERWFHGHLSGKEAEKLLTEKGKHGSFLVRESQSHPGDF

SEQ ID NO: 8215 - protein, 40 aa, Artificial Sequence
  Description of Artificial Sequence: Synthetic polypeptide
SERWFHGHLSGKEAEKLLTEKGKHGSFLVRESQSHPGDFV

SEQ ID NO: 8216 - protein, 40 aa, Artificial Sequence
  Description of Artificial Sequence: Synthetic polypeptide
ERWFHGHLSGKEAEKLLTEKGKHGSFLVRESQSHPGDFVL

SEQ ID NO: 8217 - protein, 40 aa, Artificial Sequence
  Description of Artificial Sequence: Synthetic polypeptide
RWFHGHLSGKEAEKLLTEKGKHGSFLVRESQSHPGDFVLS

SEQ ID NO: 8218 - protein, 40 aa, Artificial Sequence
  Description of Artificial Sequence: Synthetic polypeptide
WFHGHLSGKEAEKLLTEKGKHGSFLVRESQSHPGDFVLSV

SEQ ID NO: 8219 - protein, 40 aa, Artificial Sequence
  Description of Artificial Sequence: Synthetic polypeptide
FHGHLSGKEAEKLLTEKGKHGSFLVRESQSHPGDFVLSVR

SEQ ID NO: 8220 - protein, 40 aa, Artificial Sequence
  Description of Artificial Sequence: Synthetic polypeptide
HGHLSGKEAEKLLTEKGKHGSFLVRESQSHPGDFVLSVRT

SEQ ID NO: 8221 - protein, 40 aa, Artificial Sequence
  Description of Artificial Sequence: Synthetic polypeptide
KEAEKLLTEKGKHGSFLVRESQSHPGDFVLSVRTGDDKGE

SEQ ID NO: 8222 - protein, 40 aa, Artificial Sequence
  Description of Artificial Sequence: Synthetic polypeptide
AEKLLTEKGKHGSFLVRESQSHPGDFVLSVRTGDDKGESN

SEQ ID NO: 8223 - protein, 40 aa, Artificial Sequence
  Description of Artificial Sequence: Synthetic polypeptide
EKLLTEKGKHGSFLVRESQSHPGDFVLSVRTGDDKGESND

SEQ ID NO: 8224 - protein, 40 aa, Artificial Sequence
  Description of Artificial Sequence: Synthetic polypeptide
KLLTEKGKHGSFLVRESQSHPGDFVLSVRTGDDKGESNDG

SEQ ID NO: 8225 - protein, 40 aa, Artificial Sequence
  Description of Artificial Sequence: Synthetic polypeptide
LLTEKGKHGSFLVRESQSHPGDFVLSVRTGDDKGESNDGK

SEQ ID NO: 8226 - protein, 40 aa, Artificial Sequence
  Description of Artificial Sequence: Synthetic polypeptide
LTEKGKHGSFLVRESQSHPGDFVLSVRTGDDKGESNDGKS

SEQ ID NO: 8227 - protein, 40 aa, Artificial Sequence
  Description of Artificial Sequence: Synthetic polypeptide
EKGKHGSFLVRESQSHPGDFVLSVRTGDDKGESNDGKSKV

SEQ ID NO: 8228 - protein, 40 aa, Artificial Sequence
  Description of Artificial Sequence: Synthetic polypeptide
GSFLVRESQSHPGDFVLSVRTGDDKGESNDGKSKVTHVMI

SEQ ID NO: 8229 - protein, 40 aa, Artificial Sequence
  Description of Artificial Sequence: Synthetic polypeptide
QSHPGDFVLSVRTGDDKGESNDGKSKVTHVMIRCQELKYD

SEQ ID NO: 8230 - protein, 40 aa, Artificial Sequence
  Description of Artificial Sequence: Synthetic polypeptide
NDGKSKVTHVMIRCQELKYDVGGGERFDSLTDLVEHYKKN

SEQ ID NO: 8231 - protein, 40 aa, Artificial Sequence
  Description of Artificial Sequence: Synthetic polypeptide
THVMIRCQELKYDVGGGERFDSLTDLVEHYKKNPMVETLG

SEQ ID NO: 8232 - protein, 40 aa, Artificial Sequence
  Description of Artificial Sequence: Synthetic polypeptide
MIRCQELKYDVGGGERFDSLTDLVEHYKKNPMVETLGTVL

SEQ ID NO: 8233 - protein, 40 aa, Artificial Sequence
  Description of Artificial Sequence: Synthetic polypeptide
IRCQELKYDVGGGERFDSLTDLVEHYKKNPMVETLGTVLQ

SEQ ID NO: 8234 - protein, 40 aa, Artificial Sequence
  Description of Artificial Sequence: Synthetic polypeptide
CQELKYDVGGGERFDSLTDLVEHYKKNPMVETLGTVLQLK

SEQ ID NO: 8235 - protein, 40 aa, Artificial Sequence
  Description of Artificial Sequence: Synthetic polypeptide
ELKYDVGGGERFDSLTDLVEHYKKNPMVETLGTVLQLKQP

SEQ ID NO: 8236 - protein, 40 aa, Artificial Sequence
  Description of Artificial Sequence: Synthetic polypeptide
KYDVGGGERFDSLTDLVEHYKKNPMVETLGTVLQLKQPLN

SEQ ID NO: 8237 - protein, 40 aa, Artificial Sequence
  Description of Artificial Sequence: Synthetic polypeptide
GGGERFDSLTDLVEHYKKNPMVETLGTVLQLKQPLNTTRI

SEQ ID NO: 8238 - protein, 40 aa, Artificial Sequence
  Description of Artificial Sequence: Synthetic polypeptide
DLVEHYKKNPMVETLGTVLQLKQPLNTTRINAAEIESRVR

SEQ ID NO: 8239 - protein, 40 aa, Artificial Sequence
  Description of Artificial Sequence: Synthetic polypeptide
HYKKNPMVETLGTVLQLKQPLNTTRINAAEIESRVRELSK

SEQ ID NO: 8240 - protein, 40 aa, Artificial Sequence
  Description of Artificial Sequence: Synthetic polypeptide
YKKNPMVETLGTVLQLKQPLNTTRINAAEIESRVRELSKL

SEQ ID NO: 8241 - protein, 40 aa, Artificial Sequence
  Description of Artificial Sequence: Synthetic polypeptide
PMVETLGTVLQLKQPLNTTRINAAEIESRVRELSKLAETT

SEQ ID NO: 8242 - protein, 40 aa, Artificial Sequence
  Description of Artificial Sequence: Synthetic polypeptide
MVETLGTVLQLKQPLNTTRINAAEIESRVRELSKLAETTD

SEQ ID NO: 8243 - protein, 40 aa, Artificial Sequence
  Description of Artificial Sequence: Synthetic polypeptide
GTVLQLKQPLNTTRINAAEIESRVRELSKLAETTDKVKQG

SEQ ID NO: 8244 - protein, 40 aa, Artificial Sequence
  Description of Artificial Sequence: Synthetic polypeptide
LQLKQPLNTTRINAAEIESRVRELSKLAETTDKVKQGFWE

SEQ ID NO: 8245 - protein, 40 aa, Artificial Sequence
  Description of Artificial Sequence: Synthetic polypeptide
KQPLNTTRINAAEIESRVRELSKLAETTDKVKQGFWEEFE

SEQ ID NO: 8246 - protein, 40 aa, Artificial Sequence
  Description of Artificial Sequence: Synthetic polypeptide
TTRINAAEIESRVRELSKLAETTDKVKQGFWEEFETLQQQ

SEQ ID NO: 8247 - protein, 40 aa, Artificial Sequence
  Description of Artificial Sequence: Synthetic polypeptide
EIESRVRELSKLAETTDKVKQGFWEEFETLQQQECKLLYS

SEQ ID NO: 8248 - protein, 40 aa, Artificial Sequence
  Description of Artificial Sequence: Synthetic polypeptide
RELSKLAETTDKVKQGFWEEFETLQQQECKLLYSRKEGQR

SEQ ID NO: 8249 - protein, 40 aa, Artificial Sequence
  Description of Artificial Sequence: Synthetic polypeptide
ELSKLAETTDKVKQGFWEEFETLQQQECKLLYSRKEGQRQ

SEQ ID NO: 8250 - protein, 40 aa, Artificial Sequence
  Description of Artificial Sequence: Synthetic polypeptide
LSKLAETTDKVKQGFWEEFETLQQQECKLLYSRKEGQRQE

SEQ ID NO: 8251 - protein, 40 aa, Artificial Sequence
  Description of Artificial Sequence: Synthetic polypeptide
KLAETTDKVKQGFWEEFETLQQQECKLLYSRKEGQRQENK

SEQ ID NO: 8252 - protein, 40 aa, Artificial Sequence
  Description of Artificial Sequence: Synthetic polypeptide
AETTDKVKQGFWEEFETLQQQECKLLYSRKEGQRQENKNK

SEQ ID NO: 8253 - protein, 40 aa, Artificial Sequence
  Description of Artificial Sequence: Synthetic polypeptide
ETTDKVKQGFWEEFETLQQQECKLLYSRKEGQRQENKNKN

SEQ ID NO: 8254 - protein, 40 aa, Artificial Sequence
  Description of Artificial Sequence: Synthetic polypeptide
TDKVKQGFWEEFETLQQQECKLLYSRKEGQRQENKNKNRY

SEQ ID NO: 8255 - protein, 40 aa, Artificial Sequence
  Description of Artificial Sequence: Synthetic polypeptide
GFWEEFETLQQQECKLLYSRKEGQRQENKNKNRYKNILPF

SEQ ID NO: 8256 - protein, 40 aa, Artificial Sequence
  Description of Artificial Sequence: Synthetic polypeptide
FWEEFETLQQQECKLLYSRKEGQRQENKNKNRYKNILPFD

SEQ ID NO: 8257 - protein, 40 aa, Artificial Sequence
  Description of Artificial Sequence: Synthetic polypeptide
WEEFETLQQQECKLLYSRKEGQRQENKNKNRYKNILPFDH

SEQ ID NO: 8258 - protein, 40 aa, Artificial Sequence
  Description of Artificial Sequence: Synthetic polypeptide
EEFETLQQQECKLLYSRKEGQRQENKNKNRYKNILPFDHT

SEQ ID NO: 8259 - protein, 40 aa, Artificial Sequence
  Description of Artificial Sequence: Synthetic polypeptide
EFETLQQQECKLLYSRKEGQRQENKNKNRYKNILPFDHTR

SEQ ID NO: 8260 - protein, 40 aa, Artificial Sequence
  Description of Artificial Sequence: Synthetic polypeptide
FETLQQQECKLLYSRKEGQRQENKNKNRYKNILPFDHTRV

SEQ ID NO: 8261 - protein, 40 aa, Artificial Sequence
  Description of Artificial Sequence: Synthetic polypeptide
TLQQQECKLLYSRKEGQRQENKNKNRYKNILPFDHTRVVL

SEQ ID NO: 8262 - protein, 40 aa, Artificial Sequence
  Description of Artificial Sequence: Synthetic polypeptide
QQQECKLLYSRKEGQRQENKNKNRYKNILPFDHTRVVLHD

SEQ ID NO: 8263 - protein, 40 aa, Artificial Sequence
  Description of Artificial Sequence: Synthetic polypeptide
QQECKLLYSRKEGQRQENKNKNRYKNILPFDHTRVVLHDG

SEQ ID NO: 8264 - protein, 40 aa, Artificial Sequence
  Description of Artificial Sequence: Synthetic polypeptide
QECKLLYSRKEGQRQENKNKNRYKNILPFDHTRVVLHDGD

SEQ ID NO: 8265 - protein, 40 aa, Artificial Sequence
  Description of Artificial Sequence: Synthetic polypeptide
ECKLLYSRKEGQRQENKNKNRYKNILPFDHTRVVLHDGDP

SEQ ID NO: 8266 - protein, 40 aa, Artificial Sequence
  Description of Artificial Sequence: Synthetic polypeptide
CKLLYSRKEGQRQENKNKNRYKNILPFDHTRVVLHDGDPN

SEQ ID NO: 8267 - protein, 40 aa, Artificial Sequence
  Description of Artificial Sequence: Synthetic polypeptide
KLLYSRKEGQRQENKNKNRYKNILPFDHTRVVLHDGDPNE

SEQ ID NO: 8268 - protein, 40 aa, Artificial Sequence
  Description of Artificial Sequence: Synthetic polypeptide
LLYSRKEGQRQENKNKNRYKNILPFDHTRVVLHDGDPNEP

SEQ ID NO: 8269 - protein, 40 aa, Artificial Sequence
  Description of Artificial Sequence: Synthetic polypeptide
YSRKEGQRQENKNKNRYKNILPFDHTRVVLHDGDPNEPVS

SEQ ID NO: 8270 - protein, 40 aa, Artificial Sequence
  Description of Artificial Sequence: Synthetic polypeptide
SRKEGQRQENKNKNRYKNILPFDHTRVVLHDGDPNEPVSD

SEQ ID NO: 8271 - protein, 40 aa, Artificial Sequence
  Description of Artificial Sequence: Synthetic polypeptide
RKEGQRQENKNKNRYKNILPFDHTRVVLHDGDPNEPVSDY

SEQ ID NO: 8272 - protein, 40 aa, Artificial Sequence
  Description of Artificial Sequence: Synthetic polypeptide
KEGQRQENKNKNRYKNILPFDHTRVVLHDGDPNEPVSDYI

SEQ ID NO: 8273 - protein, 40 aa, Artificial Sequence
  Description of Artificial Sequence: Synthetic polypeptide
EGQRQENKNKNRYKNILPFDHTRVVLHDGDPNEPVSDYIN

SEQ ID NO: 8274 - protein, 40 aa, Artificial Sequence
  Description of Artificial Sequence: Synthetic polypeptide
NKNKNRYKNILPFDHTRVVLHDGDPNEPVSDYINANIIMP

SEQ ID NO: 8275 - protein, 40 aa, Artificial Sequence
  Description of Artificial Sequence: Synthetic polypeptide
KNRYKNILPFDHTRVVLHDGDPNEPVSDYINANIIMPEFE

SEQ ID NO: 8276 - protein, 40 aa, Artificial Sequence
  Description of Artificial Sequence: Synthetic polypeptide
NRYKNILPFDHTRVVLHDGDPNEPVSDYINANIIMPEFET

SEQ ID NO: 8277 - protein, 40 aa, Artificial Sequence
  Description of Artificial Sequence: Synthetic polypeptide
QGCLQNTVNDFWRMVFQENSRVIVMTTKEVERGKSKCVKY

SEQ ID NO: 8278 - protein, 40 aa, Artificial Sequence
  Description of Artificial Sequence: Synthetic polypeptide
MVFQENSRVIVMTTKEVERGKSKCVKYWPDEYALKEYGVM

SEQ ID NO: 8279 - protein, 40 aa, Artificial Sequence
  Description of Artificial Sequence: Synthetic polypeptide
QENSRVIVMTTKEVERGKSKCVKYWPDEYALKEYGVMRVR

SEQ ID NO: 8280 - protein, 40 aa, Artificial Sequence
  Description of Artificial Sequence: Synthetic polypeptide
TTKEVERGKSKCVKYWPDEYALKEYGVMRVRNVKESAAHD

SEQ ID NO: 8281 - protein, 40 aa, Artificial Sequence
  Description of Artificial Sequence: Synthetic polypeptide
KCVKYWPDEYALKEYGVMRVRNVKESAAHDYTLRELKLSK

SEQ ID NO: 8282 - protein, 40 aa, Artificial Sequence
  Description of Artificial Sequence: Synthetic polypeptide
CVKYWPDEYALKEYGVMRVRNVKESAAHDYTLRELKLSKV

SEQ ID NO: 8283 - protein, 40 aa, Artificial Sequence
  Description of Artificial Sequence: Synthetic polypeptide
VKYWPDEYALKEYGVMRVRNVKESAAHDYTLRELKLSKVG

SEQ ID NO: 8284 - protein, 40 aa, Artificial Sequence
  Description of Artificial Sequence: Synthetic polypeptide
PDEYALKEYGVMRVRNVKESAAHDYTLRELKLSKVGQGNT

SEQ ID NO: 8285 - protein, 40 aa, Artificial Sequence
  Description of Artificial Sequence: Synthetic polypeptide
DEYALKEYGVMRVRNVKESAAHDYTLRELKLSKVGQGNTE

SEQ ID NO: 8286 - protein, 40 aa, Artificial Sequence
  Description of Artificial Sequence: Synthetic polypeptide
LKEYGVMRVRNVKESAAHDYTLRELKLSKVGQGNTERTVW

SEQ ID NO: 8287 - protein, 40 aa, Artificial Sequence
  Description of Artificial Sequence: Synthetic polypeptide
KEYGVMRVRNVKESAAHDYTLRELKLSKVGQGNTERTVWQ

SEQ ID NO: 8288 - protein, 40 aa, Artificial Sequence
  Description of Artificial Sequence: Synthetic polypeptide
EYGVMRVRNVKESAAHDYTLRELKLSKVGQGNTERTVWQY

SEQ ID NO: 8289 - protein, 40 aa, Artificial Sequence
  Description of Artificial Sequence: Synthetic polypeptide
GVMRVRNVKESAAHDYTLRELKLSKVGQGNTERTVWQYHF

SEQ ID NO: 8290 - protein, 40 aa, Artificial Sequence
  Description of Artificial Sequence: Synthetic polypeptide
VMRVRNVKESAAHDYTLRELKLSKVGQGNTERTVWQYHFR

SEQ ID NO: 8291 - protein, 40 aa, Artificial Sequence
  Description of Artificial Sequence: Synthetic polypeptide
EVHHKQESIMDAGPVVVHCSAGIGRTGTFIVIDILIDIIR

SEQ ID NO: 8292 - protein, 40 aa, Artificial Sequence
  Description of Artificial Sequence: Synthetic polypeptide
HHKQESIMDAGPVVVHCSAGIGRTGTFIVIDILIDIIREK

SEQ ID NO: 8293 - protein, 40 aa, Artificial Sequence
  Description of Artificial Sequence: Synthetic polypeptide
KQESIMDAGPVVVHCSAGIGRTGTFIVIDILIDIIREKGV

SEQ ID NO: 8294 - protein, 40 aa, Artificial Sequence
  Description of Artificial Sequence: Synthetic polypeptide
ESIMDAGPVVVHCSAGIGRTGTFIVIDILIDIIREKGVDC

SEQ ID NO: 8295 - protein, 40 aa, Artificial Sequence
  Description of Artificial Sequence: Synthetic polypeptide
DAGPVVVHCSAGIGRTGTFIVIDILIDIIREKGVDCDIDV

SEQ ID NO: 8296 - protein, 40 aa, Artificial Sequence
  Description of Artificial Sequence: Synthetic polypeptide
VVHCSAGIGRTGTFIVIDILIDIIREKGVDCDIDVPKTIQ

SEQ ID NO: 8297 - protein, 40 aa, Artificial Sequence
  Description of Artificial Sequence: Synthetic polypeptide
GIGRTGTFIVIDILIDIIREKGVDCDIDVPKTIQMVRSQR

SEQ ID NO: 8298 - protein, 40 aa, Artificial Sequence
  Description of Artificial Sequence: Synthetic polypeptide
IGRTGTFIVIDILIDIIREKGVDCDIDVPKTIQMVRSQRS

SEQ ID NO: 8299 - protein, 40 aa, Artificial Sequence
  Description of Artificial Sequence: Synthetic polypeptide
IDIIREKGVDCDIDVPKTIQMVRSQRSGMVQTEAQYRFIY

SEQ ID NO: 8300 - protein, 40 aa, Artificial Sequence
  Description of Artificial Sequence: Synthetic polypeptide
KGVDCDIDVPKTIQMVRSQRSGMVQTEAQYRFIYMAVQHY

SEQ ID NO: 8301 - protein, 40 aa, Artificial Sequence
  Description of Artificial Sequence: Synthetic polypeptide
VDCDIDVPKTIQMVRSQRSGMVQTEAQYRFIYMAVQHYIE

SEQ ID NO: 8302 - protein, 40 aa, Artificial Sequence
  Description of Artificial Sequence: Synthetic polypeptide
QRSGMVQTEAQYRFIYMAVQHYIETLQRRIEEEQKSKRKG

SEQ ID NO: 8303 - protein, 40 aa, Artificial Sequence
  Description of Artificial Sequence: Synthetic polypeptide
RFIYMAVQHYIETLQRRIEEEQKSKRKGHEYTNIKYSLAD

SEQ ID NO: 8304 - protein, 40 aa, Artificial Sequence
  Description of Artificial Sequence: Synthetic polypeptide
FIYMAVQHYIETLQRRIEEEQKSKRKGHEYTNIKYSLADQ

SEQ ID NO: 8305 - protein, 40 aa, Artificial Sequence
  Description of Artificial Sequence: Synthetic polypeptide
YMAVQHYIETLQRRIEEEQKSKRKGHEYTNIKYSLADQTS

SEQ ID NO: 8306 - protein, 40 aa, Artificial Sequence
  Description of Artificial Sequence: Synthetic polypeptide
QHYIETLQRRIEEEQKSKRKGHEYTNIKYSLADQTSGDQS

SEQ ID NO: 8307 - protein, 40 aa, Artificial Sequence
  Description of Artificial Sequence: Synthetic polypeptide
HYIETLQRRIEEEQKSKRKGHEYTNIKYSLADQTSGDQSP

SEQ ID NO: 8308 - protein, 40 aa, Artificial Sequence
  Description of Artificial Sequence: Synthetic polypeptide
YIETLQRRIEEEQKSKRKGHEYTNIKYSLADQTSGDQSPL

SEQ ID NO: 8309 - protein, 40 aa, Artificial Sequence
  Description of Artificial Sequence: Synthetic polypeptide
IETLQRRIEEEQKSKRKGHEYTNIKYSLADQTSGDQSPLP

SEQ ID NO: 8310 - protein, 40 aa, Artificial Sequence
  Description of Artificial Sequence: Synthetic polypeptide
NIKYSLADQTSGDQSPLPPCTPTPPCAEMREDSARVYENV

SEQ ID NO: 8311 - protein, 40 aa, Artificial Sequence
  Description of Artificial Sequence: Synthetic polypeptide
ARMFAENNGLLFLETSALDSTNVELAFETVLKEIFAKVSK

SEQ ID NO: 8312 - protein, 40 aa, Artificial Sequence
  Description of Artificial Sequence: Synthetic polypeptide
NGLLFLETSALDSTNVELAFETVLKEIFAKVSKQRQNSIR

SEQ ID NO: 8313 - protein, 40 aa, Artificial Sequence
  Description of Artificial Sequence: Synthetic polypeptide
GLLFLETSALDSTNVELAFETVLKEIFAKVSKQRQNSIRT

SEQ ID NO: 8314 - protein, 40 aa, Artificial Sequence
  Description of Artificial Sequence: Synthetic polypeptide
AIKCVVVGDGAVGKTCLLISYTTNAFPGEYIPTVFDNYSA

SEQ ID NO: 8315 - protein, 40 aa, Artificial Sequence
  Description of Artificial Sequence: Synthetic polypeptide
IKCVVVGDGAVGKTCLLISYTTNAFPGEYIPTVFDNYSAN

SEQ ID NO: 8316 - protein, 40 aa, Artificial Sequence
  Description of Artificial Sequence: Synthetic polypeptide
CVVVGDGAVGKTCLLISYTTNAFPGEYIPTVFDNYSANVM

SEQ ID NO: 8317 - protein, 40 aa, Artificial Sequence
  Description of Artificial Sequence: Synthetic polypeptide
VGDGAVGKTCLLISYTTNAFPGEYIPTVFDNYSANVMVDG

SEQ ID NO: 8318 - protein, 40 aa, Artificial Sequence
  Description of Artificial Sequence: Synthetic polypeptide
KTCLLISYTTNAFPGEYIPTVFDNYSANVMVDGKPVNLGL

SEQ ID NO: 8319 - protein, 40 aa, Artificial Sequence
  Description of Artificial Sequence: Synthetic polypeptide
CLLISYTTNAFPGEYIPTVFDNYSANVMVDGKPVNLGLWD

SEQ ID NO: 8320 - protein, 40 aa, Artificial Sequence
  Description of Artificial Sequence: Synthetic polypeptide
PTVFDNYSANVMVDGKPVNLGLWDTAGQEDYDRLRPLSYP

SEQ ID NO: 8321 - protein, 40 aa, Artificial Sequence
  Description of Artificial Sequence: Synthetic polypeptide
NVMVDGKPVNLGLWDTAGQEDYDRLRPLSYPQTVGETYGK

SEQ ID NO: 8322 - protein, 40 aa, Artificial Sequence
  Description of Artificial Sequence: Synthetic polypeptide
DGKPVNLGLWDTAGQEDYDRLRPLSYPQTVGETYGKDITS

SEQ ID NO: 8323 - protein, 40 aa, Artificial Sequence
  Description of Artificial Sequence: Synthetic polypeptide
GKPVNLGLWDTAGQEDYDRLRPLSYPQTVGETYGKDITSR

SEQ ID NO: 8324 - protein, 40 aa, Artificial Sequence
  Description of Artificial Sequence: Synthetic polypeptide
PVNLGLWDTAGQEDYDRLRPLSYPQTVGETYGKDITSRGK

SEQ ID NO: 8325 - protein, 40 aa, Artificial Sequence
  Description of Artificial Sequence: Synthetic polypeptide
VNLGLWDTAGQEDYDRLRPLSYPQTVGETYGKDITSRGKD

SEQ ID NO: 8326 - protein, 40 aa, Artificial Sequence
  Description of Artificial Sequence: Synthetic polypeptide
MGLWDTAGQEDYDRLRPLSYPQTVGETYGKDITSRGKDKP

SEQ ID NO: 8327 - protein, 40 aa, Artificial Sequence
  Description of Artificial Sequence: Synthetic polypeptide
GLWDTAGQEDYDRLRPLSYPQTVGETYGKDITSRGKDKPI

SEQ ID NO: 8328 - protein, 40 aa, Artificial Sequence
  Description of Artificial Sequence: Synthetic polypeptide
LWDTAGQEDYDRLRPLSYPQTVGETYGKDITSRGKDKPIA

SEQ ID NO: 8329 - protein, 40 aa, Artificial Sequence
  Description of Artificial Sequence: Synthetic polypeptide
AGQEDYDRLRPLSYPQTVGETYGKDITSRGKDKPIADVFL

SEQ ID NO: 8330 - protein, 40 aa, Artificial Sequence
  Description of Artificial Sequence: Synthetic polypeptide
QEDYDRLRPLSYPQTVGETYGKDITSRGKDKPIADVFLIC

SEQ ID NO: 8331 - protein, 40 aa, Artificial Sequence
  Description of Artificial Sequence: Synthetic polypeptide
RLRPLSYPQTVGETYGKDITSRGKDKPIADVFLICFSLVS

SEQ ID NO: 8332 - protein, 40 aa, Artificial Sequence
  Description of Artificial Sequence: Synthetic polypeptide
PQTVGETYGKDITSRGKDKPIADVFLICFSLVSPASFENV

SEQ ID NO: 8333 - protein, 40 aa, Artificial Sequence
  Description of Artificial Sequence: Synthetic polypeptide
QTVGETYGKDITSRGKDKPIADVFLICFSLVSPASFENVR

SEQ ID NO: 8334 - protein, 40 aa, Artificial Sequence
  Description of Artificial Sequence: Synthetic polypeptide
ETYGKDITSRGKDKPIADVFLICFSLVSPASFENVRAKWY

SEQ ID NO: 8335 - protein, 40 aa, Artificial Sequence
  Description of Artificial Sequence: Synthetic polypeptide
YGKDITSRGKDKPIADVFLICFSLVSPASFENVRAKWYPE

SEQ ID NO: 8336 - protein, 40 aa, Artificial Sequence
  Description of Artificial Sequence: Synthetic polypeptide
RGKDKPIADVFLICFSLVSPASFENVRAKWYPEVRHHCPN

SEQ ID NO: 8337 - protein, 40 aa, Artificial Sequence
  Description of Artificial Sequence: Synthetic polypeptide
DKPIADVFLICFSLVSPASFENVRAKWYPEVRHHCPNTPI

SEQ ID NO: 8338 - protein, 40 aa, Artificial Sequence
  Description of Artificial Sequence: Synthetic polypeptide
KLDLRDDKDTIEKLKEKKLTPITYPQGLAMAKEIGAVKYL

SEQ ID NO: 8339 - protein, 40 aa, Artificial Sequence
  Description of Artificial Sequence: Synthetic polypeptide
PQGLAMAKEIGAVKYLECSALTQRGLKTVFDEAIRAVLCP

SEQ ID NO: 8340 - protein, 40 aa, Artificial Sequence
  Description of Artificial Sequence: Synthetic polypeptide
DPSKTSNTIRVFLPNKQRTVVNVRNGMSLHDCLMKALKVR

SEQ ID NO: 8341 - protein, 40 aa, Artificial Sequence
  Description of Artificial Sequence: Synthetic polypeptide
RVFLPNKQRTVVNVRNGMSLHDCLMKALKVRGLQPECCAV

SEQ ID NO: 8342 - protein, 40 aa, Artificial Sequence
  Description of Artificial Sequence: Synthetic polypeptide
VVNVRNGMSLHDCLMKALKVRGLQPECCAVFRLLHEHKGK

SEQ ID NO: 8343 - protein, 40 aa, Artificial Sequence
  Description of Artificial Sequence: Synthetic polypeptide
VNVRNGMSLHDCLMKALKVRGLQPECCAVFRLLHEHKGKK

SEQ ID NO: 8344 - protein, 40 aa, Artificial Sequence
  Description of Artificial Sequence: Synthetic polypeptide
NVRNGMSLHDCLMKALKVRGLQPECCAVFRLLHEHKGKKA

SEQ ID NO: 8345 - protein, 40 aa, Artificial Sequence
  Description of Artificial Sequence: Synthetic polypeptide
RNGMSLHDCLMKALKVRGLQPECCAVFRLLHEHKGKKARL

SEQ ID NO: 8346 - protein, 40 aa, Artificial Sequence
  Description of Artificial Sequence: Synthetic polypeptide
HDCLMKALKVRGLQPECCAVFRLLHEHKGKKARLDWNTDA

SEQ ID NO: 8347 - protein, 40 aa, Artificial Sequence
  Description of Artificial Sequence: Synthetic polypeptide
DCLMKALKVRGLQPECCAVFRLLHEHKGKKARLDWNTDAA

SEQ ID NO: 8348 - protein, 40 aa, Artificial Sequence
  Description of Artificial Sequence: Synthetic polypeptide
KALKVRGLQPECCAVFRLLHEHKGKKARLDWNTDAASLIG

SEQ ID NO: 8349 - protein, 40 aa, Artificial Sequence
  Description of Artificial Sequence: Synthetic polypeptide
ALKVRGLQPECCAVFRLLHEHKGKKARLDWNTDAASLIGE

SEQ ID NO: 8350 - protein, 40 aa, Artificial Sequence
  Description of Artificial Sequence: Synthetic polypeptide
KVRGLQPECCAVFRLLHEHKGKKARLDWNTDAASLIGEEL

SEQ ID NO: 8351 - protein, 40 aa, Artificial Sequence
  Description of Artificial Sequence: Synthetic polypeptide
PECCAVFRLLHEHKGKKARLDWNTDAASLIGEELQVDFLD

SEQ ID NO: 8352 - protein, 40 aa, Artificial Sequence
  Description of Artificial Sequence: Synthetic polypeptide
EHKGKKARLDWNTDAASLIGEELQVDFLDHVPLTTHNFAR

SEQ ID NO: 8353 - protein, 40 aa, Artificial Sequence
  Description of Artificial Sequence: Synthetic polypeptide
HKGKKARLDWNTDAASLIGEELQVDFLDHVPLTTHNFARK

SEQ ID NO: 8354 - protein, 40 aa, Artificial Sequence
  Description of Artificial Sequence: Synthetic polypeptide
CVDWSNIRQLLLFPNSTIGDSGVPALPSLTMRRMRESVSR

SEQ ID NO: 8355 - protein, 40 aa, Artificial Sequence
  Description of Artificial Sequence: Synthetic polypeptide
LLLFPNSTIGDSGVPALPSLTMRRMRESVSRMPVSSQHRY

SEQ ID NO: 8356 - protein, 40 aa, Artificial Sequence
  Description of Artificial Sequence: Synthetic polypeptide
LLFPNSTIGDSGVPALPSLTMRRMRESVSRMPVSSQHRYS

SEQ ID NO: 8357 - protein, 40 aa, Artificial Sequence
  Description of Artificial Sequence: Synthetic polypeptide
GDSGVPALPSLTMRRMRESVSRMPVSSQHRYSTPHAFTFN

SEQ ID NO: 8358 - protein, 40 aa, Artificial Sequence
  Description of Artificial Sequence: Synthetic polypeptide
ALPSLTMRRMRESVSRMPVSSQHRYSTPHAFTFNTSSPSS

SEQ ID NO: 8359 - protein, 40 aa, Artificial Sequence
  Description of Artificial Sequence: Synthetic polypeptide
LPSLTMRRMRESVSRMPVSSQHRYSTPHAFTFNTSSPSSE

SEQ ID NO: 8360 - protein, 40 aa, Artificial Sequence
  Description of Artificial Sequence: Synthetic polypeptide
SLTMRRMRESVSRMPVSSQHRYSTPHAFTFNTSSPSSEGS

SEQ ID NO: 8361 - protein, 40 aa, Artificial Sequence
  Description of Artificial Sequence: Synthetic polypeptide
RRMRESVSRMPVSSQHRYSTPHAFTFNTSSPSSEGSLSQR

SEQ ID NO: 8362 - protein, 40 aa, Artificial Sequence
  Description of Artificial Sequence: Synthetic polypeptide
IEDAIRSHSESASPSALSSSPNNLSPTGWSQPKTPVPAQR

SEQ ID NO: 8363 - protein, 40 aa, Artificial Sequence
  Description of Artificial Sequence: Synthetic polypeptide
SALSSSPNNLSPTGWSQPKTPVPAQRERAPVSGTQEKNKI

SEQ ID NO: 8364 - protein, 40 aa, Artificial Sequence
  Description of Artificial Sequence: Synthetic polypeptide
SSPNNLSPTGWSQPKTPVPAQRERAPVSGTQEKNKIRPRG

SEQ ID NO: 8365 - protein, 40 aa, Artificial Sequence
  Description of Artificial Sequence: Synthetic polypeptide
NLSPTGWSQPKTPVPAQRERAPVSGTQEKNKIRPRGQRDS

SEQ ID NO: 8366 - protein, 40 aa, Artificial Sequence
  Description of Artificial Sequence: Synthetic polypeptide
SPTGWSQPKTPVPAQRERAPVSGTQEKNKIRPRGQRDSSY

SEQ ID NO: 8367 - protein, 40 aa, Artificial Sequence
  Description of Artificial Sequence: Synthetic polypeptide
KTPVPAQRERAPVSGTQEKNKIRPRGQRDSSYYWEIEASE

SEQ ID NO: 8368 - protein, 40 aa, Artificial Sequence
  Description of Artificial Sequence: Synthetic polypeptide
PAQRERAPVSGTQEKNKIRPRGQRDSSYYWEIEASEVMLS

SEQ ID NO: 8369 - protein, 40 aa, Artificial Sequence
  Description of Artificial Sequence: Synthetic polypeptide
AQRERAPVSGTQEKNKIRPRGQRDSSYYWEIEASEVMLST

SEQ ID NO: 8370 - protein, 40 aa, Artificial Sequence
  Description of Artificial Sequence: Synthetic polypeptide
RAPVSGTQEKNKIRPRGQRDSSYYWEIEASEVMLSTRIGS

SEQ ID NO: 8371 - protein, 40 aa, Artificial Sequence
  Description of Artificial Sequence: Synthetic polypeptide
KIRPRGQRDSSYYWEIEASEVMLSTRIGSGSFGTVYKGKW

SEQ ID NO: 8372 - protein, 40 aa, Artificial Sequence
  Description of Artificial Sequence: Synthetic polypeptide
GQRDSSYYWEIEASEVMLSTRIGSGSFGTVYKGKWHGDVA

SEQ ID NO: 8373 - protein, 40 aa, Artificial Sequence
  Description of Artificial Sequence: Synthetic polypeptide
WEIEASEVMLSTRIGSGSFGTVYKGKWHGDVAVKILKVVD

SEQ ID NO: 8374 - protein, 40 aa, Artificial Sequence
  Description of Artificial Sequence: Synthetic polypeptide
NNIFLHEGLTVKIGDFGLATVKSRWSGSQQVEQPTGSVLW

SEQ ID NO: 8375 - protein, 40 aa, Artificial Sequence
  Description of Artificial Sequence: Synthetic polypeptide
NIFLHEGLTVKIGDFGLATVKSRWSGSQQVEQPTGSVLWM

SEQ ID NO: 8376 - protein, 40 aa, Artificial Sequence
  Description of Artificial Sequence: Synthetic polypeptide
KIGDFGLATVKSRWSGSQQVEQPTGSVLWMAPEVIRMQDN

SEQ ID NO: 8377 - protein, 40 aa, Artificial Sequence
  Description of Artificial Sequence: Synthetic polypeptide
YGIVLYELMTGELPYSHINNRDQIIFMVGRGYASPDLSKL

SEQ ID NO: 8378 - protein, 40 aa, Artificial Sequence
  Description of Artificial Sequence: Synthetic polypeptide
MYELMTGELPYSHINNRDQIIFMVGRGYASPDLSKLYKNC

SEQ ID NO: 8379 - protein, 40 aa, Artificial Sequence
  Description of Artificial Sequence: Synthetic polypeptide
YELMTGELPYSHINNRDQIIFMVGRGYASPDLSKLYKNCP

SEQ ID NO: 8380 - protein, 40 aa, Artificial Sequence
  Description of Artificial Sequence: Synthetic polypeptide
ELMTGELPYSHINNRDQIIFMVGRGYASPDLSKLYKNCPK

SEQ ID NO: 8381 - protein, 40 aa, Artificial Sequence
  Description of Artificial Sequence: Synthetic polypeptide
QIIFMVGRGYASPDLSKLYKNCPKAMKRLVADCVKKVKEE

SEQ ID NO: 8382 - protein, 40 aa, Artificial Sequence
  Description of Artificial Sequence: Synthetic polypeptide
FMVGRGYASPDLSKLYKNCPKAMKRLVADCVKKVKEERPL

SEQ ID NO: 8383 - protein, 40 aa, Artificial Sequence
  Description of Artificial Sequence: Synthetic polypeptide
MVGRGYASPDLSKLYKNCPKAMKRLVADCVKKVKEERPLF

SEQ ID NO: 8384 - protein, 40 aa, Artificial Sequence
  Description of Artificial Sequence: Synthetic polypeptide
VGRGYASPDLSKLYKNCPKAMKRLVADCVKKVKEERPLFP

SEQ ID NO: 8385 - protein, 40 aa, Artificial Sequence
  Description of Artificial Sequence: Synthetic polypeptide
GRGYASPDLSKLYKNCPKAMKRLVADCVKKVKEERPLFPQ

SEQ ID NO: 8386 - protein, 40 aa, Artificial Sequence
  Description of Artificial Sequence: Synthetic polypeptide
RGYASPDLSKLYKNCPKAMKRLVADCVKKVKEERPLFPQI

SEQ ID NO: 8387 - protein, 40 aa, Artificial Sequence
  Description of Artificial Sequence: Synthetic polypeptide
GYASPDLSKLYKNCPKAMKRLVADCVKKVKEERPLFPQIL

SEQ ID NO: 8388 - protein, 40 aa, Artificial Sequence
  Description of Artificial Sequence: Synthetic polypeptide
YASPDLSKLYKNCPKAMKRLVADCVKKVKEERPLFPQILS

SEQ ID NO: 8389 - protein, 40 aa, Artificial Sequence
  Description of Artificial Sequence: Synthetic polypeptide
ASPDLSKLYKNCPKAMKRLVADCVKKVKEERPLFPQILSS

SEQ ID NO: 8390 - protein, 40 aa, Artificial Sequence
  Description of Artificial Sequence: Synthetic polypeptide
PDLSKLYKNCPKAMKRLVADCVKKVKEERPLFPQILSSIE

SEQ ID NO: 8391 - protein, 40 aa, Artificial Sequence
  Description of Artificial Sequence: Synthetic polypeptide
DLSKLYKNCPKAMKRLVADCVKKVKEERPLFPQILSSIEL

SEQ ID NO: 8392 - protein, 40 aa, Artificial Sequence
  Description of Artificial Sequence: Synthetic polypeptide
LSKLYKNCPKAMKRLVADCVKKVKEERPLFPQILSSIELL

SEQ ID NO: 8393 - protein, 40 aa, Artificial Sequence
  Description of Artificial Sequence: Synthetic polypeptide
SKLYKNCPKAMKRLVADCVKKVKEERPLFPQILSSIELLQ

SEQ ID NO: 8394 - protein, 40 aa, Artificial Sequence
  Description of Artificial Sequence: Synthetic polypeptide
KLYKNCPKAMKRLVADCVKKVKEERPLFPQILSSIELLQH

SEQ ID NO: 8395 - protein, 40 aa, Artificial Sequence
  Description of Artificial Sequence: Synthetic polypeptide
LYKNCPKAMKRLVADCVKKVKEERPLFPQILSSIELLQHS

SEQ ID NO: 8396 - protein, 40 aa, Artificial Sequence
  Description of Artificial Sequence: Synthetic polypeptide
YKNCPKAMKRLVADCVKKVKEERPLFPQILSSIELLQHSL

SEQ ID NO: 8397 - protein, 40 aa, Artificial Sequence
  Description of Artificial Sequence: Synthetic polypeptide
KAMKRLVADCVKKVKEERPLFPQILSSIELLQHSLPKINR

SEQ ID NO: 8398 - protein, 40 aa, Artificial Sequence
  Description of Artificial Sequence: Synthetic polypeptide
RLVADCVKKVKEERPLFPQILSSIELLQHSLPKINRSASE

SEQ ID NO: 8399 - protein, 40 aa, Artificial Sequence
  Description of Artificial Sequence: Synthetic polypeptide
MVADCVKKVKEERPLFPQILSSIELLQHSLPKINRSASEP

SEQ ID NO: 8400 - protein, 40 aa, Artificial Sequence
  Description of Artificial Sequence: Synthetic polypeptide
ADCVKKVKEERPLFPQILSSIELLQHSLPKINRSASEPSL

SEQ ID NO: 8401 - protein, 40 aa, Artificial Sequence
  Description of Artificial Sequence: Synthetic polypeptide
DCVKKVKEERPLFPQILSSIELLQHSLPKINRSASEPSLH

SEQ ID NO: 8402 - protein, 40 aa, Artificial Sequence
  Description of Artificial Sequence: Synthetic polypeptide
CVKKVKEERPLFPQILSSIELLQHSLPKINRSASEPSLHR

SEQ ID NO: 8403 - protein, 40 aa, Artificial Sequence
  Description of Artificial Sequence: Synthetic polypeptide
VKKVKEERPLFPQILSSIELLQHSLPKINRSASEPSLHRA

SEQ ID NO: 8404 - protein, 40 aa, Artificial Sequence
  Description of Artificial Sequence: Synthetic polypeptide
RVKIPAALPVAAAPYPGLVETGVAGTLGGGAALGSEFLGA

SEQ ID NO: 8405 - protein, 40 aa, Artificial Sequence
  Description of Artificial Sequence: Synthetic polypeptide
KIPAALPVAAAPYPGLVETGVAGTLGGGAALGSEFLGAGS

SEQ ID NO: 8406 - protein, 40 aa, Artificial Sequence
  Description of Artificial Sequence: Synthetic polypeptide
IPAALPVAAAPYPGLVETGVAGTLGGGAALGSEFLGAGSV

SEQ ID NO: 8407 - protein, 40 aa, Artificial Sequence
  Description of Artificial Sequence: Synthetic polypeptide
PAALPVAAAPYPGLVETGVAGTLGGGAALGSEFLGAGSVA

SEQ ID NO: 8408 - protein, 40 aa, Artificial Sequence
  Description of Artificial Sequence: Synthetic polypeptide
MPVAAAPYPGLVETGVAGTLGGGAALGSEFLGAGSVAGAL

SEQ ID NO: 8409 - protein, 40 aa, Artificial Sequence
  Description of Artificial Sequence: Synthetic polypeptide
MALTKLPTSLLAETLGPGGGFPPLPPPPYLPPLGAGLGTV

SEQ ID NO: 8410 - protein, 40 aa, Artificial Sequence
  Description of Artificial Sequence: Synthetic polypeptide
GDSLDGPEYEEEEVAIPLTAPPTNQWYHGKLDRTIAEERL

SEQ ID NO: 8411 - protein, 40 aa, Artificial Sequence
  Description of Artificial Sequence: Synthetic polypeptide
DSLDGPEYEEEEVAIPLTAPPTNQWYHGKLDRTIAEERLR

SEQ ID NO: 8412 - protein, 40 aa, Artificial Sequence
  Description of Artificial Sequence: Synthetic polypeptide
PEYEEEEVAIPLTAPPTNQWYHGKLDRTIAEERLRQAGKS

SEQ ID NO: 8413 - protein, 40 aa, Artificial Sequence
  Description of Artificial Sequence: Synthetic polypeptide
MTAPPTNQWYHGKLDRTIAEERLRQAGKSGSYLIRESDRR

SEQ ID NO: 8414 - protein, 40 aa, Artificial Sequence
  Description of Artificial Sequence: Synthetic polypeptide
APPTNQWYHGKLDRTIAEERLRQAGKSGSYLIRESDRRPG

SEQ ID NO: 8415 - protein, 40 aa, Artificial Sequence
  Description of Artificial Sequence: Synthetic polypeptide
PPTNQWYHGKLDRTIAEERLRQAGKSGSYLIRESDRRPGS

SEQ ID NO: 8416 - protein, 40 aa, Artificial Sequence
  Description of Artificial Sequence: Synthetic polypeptide
TNQWYHGKLDRTIAEERLRQAGKSGSYLIRESDRRPGSFV

SEQ ID NO: 8417 - protein, 40 aa, Artificial Sequence
  Description of Artificial Sequence: Synthetic polypeptide
NQWYHGKLDRTIAEERLRQAGKSGSYLIRESDRRPGSFVL

SEQ ID NO: 8418 - protein, 40 aa, Artificial Sequence
  Description of Artificial Sequence: Synthetic polypeptide
YHGKLDRTIAEERLRQAGKSGSYLIRESDRRPGSFVLSFL

SEQ ID NO: 8419 - protein, 40 aa, Artificial Sequence
  Description of Artificial Sequence: Synthetic polypeptide
GKLDRTIAEERLRQAGKSGSYLIRESDRRPGSFVLSFLSQ

SEQ ID NO: 8420 - protein, 40 aa, Artificial Sequence
  Description of Artificial Sequence: Synthetic polypeptide
KLDRTIAEERLRQAGKSGSYLIRESDRRPGSFVLSFLSQM

SEQ ID NO: 8421 - protein, 40 aa, Artificial Sequence
  Description of Artificial Sequence: Synthetic polypeptide
IAEERLRQAGKSGSYLIRESDRRPGSFVLSFLSQMNVVNH

SEQ ID NO: 8422 - protein, 40 aa, Artificial Sequence
  Description of Artificial Sequence: Synthetic polypeptide
ERLRQAGKSGSYLIRESDRRPGSFVLSFLSQMNVVNHFRI

SEQ ID NO: 8423 - protein, 40 aa, Artificial Sequence
  Description of Artificial Sequence: Synthetic polypeptide
RLRQAGKSGSYLIRESDRRPGSFVLSFLSQMNVVNHFRII

SEQ ID NO: 8424 - protein, 40 aa, Artificial Sequence
  Description of Artificial Sequence: Synthetic polypeptide
LRQAGKSGSYLIRESDRRPGSFVLSFLSQMNVVNHFRIIA

SEQ ID NO: 8425 - protein, 40 aa, Artificial Sequence
  Description of Artificial Sequence: Synthetic polypeptide
GKSGSYLIRESDRRPGSFVLSFLSQMNVVNHFRIIAMCGD

SEQ ID NO: 8426 - protein, 40 aa, Artificial Sequence
  Description of Artificial Sequence: Synthetic polypeptide
KSGSYLIRESDRRPGSFVLSFLSQMNVVNHFRIIAMCGDY

SEQ ID NO: 8427 - protein, 40 aa, Artificial Sequence
  Description of Artificial Sequence: Synthetic polypeptide
RESDRRPGSFVLSFLSQMNVVNHFRIIAMCGDYYIGGRRF

SEQ ID NO: 8428 - protein, 40 aa, Artificial Sequence
  Description of Artificial Sequence: Synthetic polypeptide
PGSFVLSFLSQMNVVNHFRIIAMCGDYYIGGRRFSSLSDL

SEQ ID NO: 8429 - protein, 40 aa, Artificial Sequence
  Description of Artificial Sequence: Synthetic polypeptide
SFVLSFLSQMNVVNHFRIIAMCGDYYIGGRRFSSLSDLIG

SEQ ID NO: 8430 - protein, 40 aa, Artificial Sequence
  Description of Artificial Sequence: Synthetic polypeptide
FVLSFLSQMNVVNHFRIIAMCGDYYIGGRRFSSLSDLIGY

SEQ ID NO: 8431 - protein, 40 aa, Artificial Sequence
  Description of Artificial Sequence: Synthetic polypeptide
LSFLSQMNVVNHFRIIAMCGDYYIGGRRFSSLSDLIGYYS

SEQ ID NO: 8432 - protein, 40 aa, Artificial Sequence
  Description of Artificial Sequence: Synthetic polypeptide
FLSQMNVVNHFRIIAMCGDYYIGGRRFSSLSDLIGYYSHV

SEQ ID NO: 8433 - protein, 40 aa, Artificial Sequence
  Description of Artificial Sequence: Synthetic polypeptide
MNVVNHFRIIAMCGDYYIGGRRFSSLSDLIGYYSHVSCLL

SEQ ID NO: 8434 - protein, 40 aa, Artificial Sequence
  Description of Artificial Sequence: Synthetic polypeptide
VNHFRIIAMCGDYYIGGRRFSSLSDLIGYYSHVSCLLKGE

SEQ ID NO: 8435 - protein, 40 aa, Artificial Sequence
  Description of Artificial Sequence: Synthetic polypeptide
NHFRIIAMCGDYYIGGRRFSSLSDLIGYYSHVSCLLKGEK

SEQ ID NO: 8436 - protein, 40 aa, Artificial Sequence
  Description of Artificial Sequence: Synthetic polypeptide
RIIAMCGDYYIGGRRFSSLSDLIGYYSHVSCLLKGEKLLY

SEQ ID NO: 8437 - protein, 40 aa, Artificial Sequence
  Description of Artificial Sequence: Synthetic polypeptide
AMCGDYYIGGRRFSSLSDLIGYYSHVSCLLKGEKLLYPVA

SEQ ID NO: 8438 - protein, 40 aa, Artificial Sequence
  Description of Artificial Sequence: Synthetic polypeptide
CGDYYIGGRRFSSLSDLIGYYSHVSCLLKGEKLLYPVAPP

SEQ ID NO: 8439 - protein, 40 aa, Artificial Sequence
  Description of Artificial Sequence: Synthetic polypeptide
GDYYIGGRRFSSLSDLIGYYSHVSCLLKGEKLLYPVAPPE

SEQ ID NO: 8440 - protein, 40 aa, Artificial Sequence
  Description of Artificial Sequence: Synthetic polypeptide
DYYIGGRRFSSLSDLIGYYSHVSCLLKGEKLLYPVAPPEP

SEQ ID NO: 8441 - protein, 40 aa, Artificial Sequence
  Description of Artificial Sequence: Synthetic polypeptide
YYIGGRRFSSLSDLIGYYSHVSCLLKGEKLLYPVAPPEPV

SEQ ID NO: 8442 - protein, 40 aa, Artificial Sequence
  Description of Artificial Sequence: Synthetic polypeptide
YIGGRRFSSLSDLIGYYSHVSCLLKGEKLLYPVAPPEPVE

SEQ ID NO: 8443 - protein, 40 aa, Artificial Sequence
  Description of Artificial Sequence: Synthetic polypeptide
IGGRRFSSLSDLIGYYSHVSCLLKGEKLLYPVAPPEPVED

SEQ ID NO: 8444 - protein, 40 aa, Artificial Sequence
  Description of Artificial Sequence: Synthetic polypeptide
GGRRFSSLSDLIGYYSHVSCLLKGEKLLYPVAPPEPVEDR

SEQ ID NO: 8445 - protein, 40 aa, Artificial Sequence
  Description of Artificial Sequence: Synthetic polypeptide
GRRFSSLSDLIGYYSHVSCLLKGEKLLYPVAPPEPVEDRR

SEQ ID NO: 8446 - protein, 40 aa, Artificial Sequence
  Description of Artificial Sequence: Synthetic polypeptide
FSSLSDLIGYYSHVSCLLKGEKLLYPVAPPEPVEDRRRVR

SEQ ID NO: 8447 - protein, 40 aa, Artificial Sequence
  Description of Artificial Sequence: Synthetic polypeptide
SDLIGYYSHVSCLLKGEKLLYPVAPPEPVEDRRRVRAILP

SEQ ID NO: 8448 - protein, 40 aa, Artificial Sequence
  Description of Artificial Sequence: Synthetic polypeptide
DLIGYYSHVSCLLKGEKLLYPVAPPEPVEDRRRVRAILPY

SEQ ID NO: 8449 - protein, 40 aa, Artificial Sequence
  Description of Artificial Sequence: Synthetic polypeptide
LIGYYSHVSCLLKGEKLLYPVAPPEPVEDRRRVRAILPYT

SEQ ID NO: 8450 - protein, 40 aa, Artificial Sequence
  Description of Artificial Sequence: Synthetic polypeptide
PVAPPEPVEDRRRVRAILPYTKVPDTDEISFLKGDMFIVH

SEQ ID NO: 8451 - protein, 40 aa, Artificial Sequence
  Description of Artificial Sequence: Synthetic polypeptide
AILPYTKVPDTDEISFLKGDMFIVHNELEDGWMWVTNLRT

SEQ ID NO: 8452 - protein, 40 aa, Artificial Sequence
  Description of Artificial Sequence: Synthetic polypeptide
KVPDTDEISFLKGDMFIVHNELEDGWMWVTNLRTDEQGLI

SEQ ID NO: 8453 - protein, 40 aa, Artificial Sequence
  Description of Artificial Sequence: Synthetic polypeptide
VPDTDEISFLKGDMFIVHNELEDGWMWVTNLRTDEQGLIV

SEQ ID NO: 8454 - protein, 40 aa, Artificial Sequence
  Description of Artificial Sequence: Synthetic polypeptide
DTDEISFLKGDMFIVHNELEDGWMWVTNLRTDEQGLIVED

SEQ ID NO: 8455 - protein, 40 aa, Artificial Sequence
  Description of Artificial Sequence: Synthetic polypeptide
TDEISFLKGDMFIVHNELEDGWMWVTNLRTDEQGLIVEDL

SEQ ID NO: 8456 - protein, 40 aa, Artificial Sequence
  Description of Artificial Sequence: Synthetic polypeptide
IVHNELEDGWMWVTNLRTDEQGLIVEDLVEEVGREEDPHE

SEQ ID NO: 8457 - protein, 40 aa, Artificial Sequence
  Description of Artificial Sequence: Synthetic polypeptide
GWMWVTNLRTDEQGLIVEDLVEEVGREEDPHEGKIWFHGK

SEQ ID NO: 8458 - protein, 40 aa, Artificial Sequence
  Description of Artificial Sequence: Synthetic polypeptide
LRTDEQGLIVEDLVEEVGREEDPHEGKIWFHGKISKQEAY

SEQ ID NO: 8459 - protein, 40 aa, Artificial Sequence
  Description of Artificial Sequence: Synthetic polypeptide
TDEQGLIVEDLVEEVGREEDPHEGKIWFHGKISKQEAYNL

SEQ ID NO: 8460 - protein, 40 aa, Artificial Sequence
  Description of Artificial Sequence: Synthetic polypeptide
DEQGLIVEDLVEEVGREEDPHEGKIWFHGKISKQEAYNLL

SEQ ID NO: 8461 - protein, 40 aa, Artificial Sequence
  Description of Artificial Sequence: Synthetic polypeptide
EQGLIVEDLVEEVGREEDPHEGKIWFHGKISKQEAYNLLM

SEQ ID NO: 8462 - protein, 40 aa, Artificial Sequence
  Description of Artificial Sequence: Synthetic polypeptide
QGLIVEDLVEEVGREEDPHEGKIWFHGKISKQEAYNLLMT

SEQ ID NO: 8463 - protein, 40 aa, Artificial Sequence
  Description of Artificial Sequence: Synthetic polypeptide
GLIVEDLVEEVGREEDPHEGKIWFHGKISKQEAYNLLMTV

SEQ ID NO: 8464 - protein, 40 aa, Artificial Sequence
  Description of Artificial Sequence: Synthetic polypeptide
LIVEDLVEEVGREEDPHEGKIWFHGKISKQEAYNLLMTVG

SEQ ID NO: 8465 - protein, 40 aa, Artificial Sequence
  Description of Artificial Sequence: Synthetic polypeptide
LVEEVGREEDPHEGKIWFHGKISKQEAYNLLMTVGQVCSF

SEQ ID NO: 8466 - protein, 40 aa, Artificial Sequence
  Description of Artificial Sequence: Synthetic polypeptide
VEEVGREEDPHEGKIWFHGKISKQEAYNLLMTVGQVCSFL

SEQ ID NO: 8467 - protein, 40 aa, Artificial Sequence
  Description of Artificial Sequence: Synthetic polypeptide
EVGREEDPHEGKIWFHGKISKQEAYNLLMTVGQVCSFLVR

SEQ ID NO: 8468 - protein, 40 aa, Artificial Sequence
  Description of Artificial Sequence: Synthetic polypeptide
VGREEDPHEGKIWFHGKISKQEAYNLLMTVGQVCSFLVRP

SEQ ID NO: 8469 - protein, 40 aa, Artificial Sequence
  Description of Artificial Sequence: Synthetic polypeptide
REEDPHEGKIWFHGKISKQEAYNLLMTVGQVCSFLVRPSD

SEQ ID NO: 8470 - protein, 40 aa, Artificial Sequence
  Description of Artificial Sequence: Synthetic polypeptide
EEDPHEGKIWFHGKISKQEAYNLLMTVGQVCSFLVRPSDN

SEQ ID NO: 8471 - protein, 40 aa, Artificial Sequence
  Description of Artificial Sequence: Synthetic polypeptide
EDPHEGKIWFHGKISKQEAYNLLMTVGQVCSFLVRPSDNT

SEQ ID NO: 8472 - protein, 40 aa, Artificial Sequence
  Description of Artificial Sequence: Synthetic polypeptide
DPHEGKIWFHGKISKQEAYNLLMTVGQVCSFLVRPSDNTP

SEQ ID NO: 8473 - protein, 40 aa, Artificial Sequence
  Description of Artificial Sequence: Synthetic polypeptide
PHEGKIWFHGKISKQEAYNLLMTVGQVCSFLVRPSDNTPG

SEQ ID NO: 8474 - protein, 40 aa, Artificial Sequence
  Description of Artificial Sequence: Synthetic polypeptide
HEGKIWFHGKISKQEAYNLLMTVGQVCSFLVRPSDNTPGD

SEQ ID NO: 8475 - protein, 40 aa, Artificial Sequence
  Description of Artificial Sequence: Synthetic polypeptide
EGKIWFHGKISKQEAYNLLMTVGQVCSFLVRPSDNTPGDY

SEQ ID NO: 8476 - protein, 40 aa, Artificial Sequence
  Description of Artificial Sequence: Synthetic polypeptide
GKIWFHGKISKQEAYNLLMTVGQVCSFLVRPSDNTPGDYS

SEQ ID NO: 8477 - protein, 40 aa, Artificial Sequence
  Description of Artificial Sequence: Synthetic polypeptide
IWFHGKISKQEAYNLLMTVGQVCSFLVRPSDNTPGDYSLY

SEQ ID NO: 8478 - protein, 40 aa, Artificial Sequence
  Description of Artificial Sequence: Synthetic polypeptide
WFHGKISKQEAYNLLMTVGQVCSFLVRPSDNTPGDYSLYF

SEQ ID NO: 8479 - protein, 40 aa, Artificial Sequence
  Description of Artificial Sequence: Synthetic polypeptide
FHGKISKQEAYNLLMTVGQVCSFLVRPSDNTPGDYSLYFR

SEQ ID NO: 8480 - protein, 40 aa, Artificial Sequence
  Description of Artificial Sequence: Synthetic polypeptide
HGKISKQEAYNLLMTVGQVCSFLVRPSDNTPGDYSLYFRT

SEQ ID NO: 8481 - protein, 40 aa, Artificial Sequence
  Description of Artificial Sequence: Synthetic polypeptide
KQEAYNLLMTVGQVCSFLVRPSDNTPGDYSLYFRTNENIQ

SEQ ID NO: 8482 - protein, 40 aa, Artificial Sequence
  Description of Artificial Sequence: Synthetic polypeptide
EAYNLLMTVGQVCSFLVRPSDNTPGDYSLYFRTNENIQRF

SEQ ID NO: 8483 - protein, 40 aa, Artificial Sequence
  Description of Artificial Sequence: Synthetic polypeptide
AYNLLMTVGQVCSFLVRPSDNTPGDYSLYFRTNENIQRFK

SEQ ID NO: 8484 - protein, 40 aa, Artificial Sequence
  Description of Artificial Sequence: Synthetic polypeptide
LMTVGQVCSFLVRPSDNTPGDYSLYFRTNENIQRFKICPT

SEQ ID NO: 8485 - protein, 40 aa, Artificial Sequence
  Description of Artificial Sequence: Synthetic polypeptide
MTVGQVCSFLVRPSDNTPGDYSLYFRTNENIQRFKICPTP

SEQ ID NO: 8486 - protein, 40 aa, Artificial Sequence
  Description of Artificial Sequence: Synthetic polypeptide
TVGQVCSFLVRPSDNTPGDYSLYFRTNENIQRFKICPTPN

SEQ ID NO: 8487 - protein, 40 aa, Artificial Sequence
  Description of Artificial Sequence: Synthetic polypeptide
QVCSFLVRPSDNTPGDYSLYFRTNENIQRFKICPTPNNQF

SEQ ID NO: 8488 - protein, 40 aa, Artificial Sequence
  Description of Artificial Sequence: Synthetic polypeptide
VCSFLVRPSDNTPGDYSLYFRTNENIQRFKICPTPNNQFM

SEQ ID NO: 8489 - protein, 40 aa, Artificial Sequence
  Description of Artificial Sequence: Synthetic polypeptide
GDYSLYFRTNENIQRFKICPTPNNQFMMGGRYYNSIGDII

SEQ ID NO: 8490 - protein, 40 aa, Artificial Sequence
  Description of Artificial Sequence: Synthetic polypeptide
NENIQRFKICPTPNNQFMMGGRYYNSIGDIIDHYRKEQIV

SEQ ID NO: 8491 - protein, 40 aa, Artificial Sequence
  Description of Artificial Sequence: Synthetic polypeptide
NIQRFKICPTPNNQFMMGGRYYNSIGDIIDHYRKEQIVEG

SEQ ID NO: 8492 - protein, 40 aa, Artificial Sequence
  Description of Artificial Sequence: Synthetic polypeptide
IQRFKICPTPNNQFMMGGRYYNSIGDIIDHYRKEQIVEGY

SEQ ID NO: 8493 - protein, 40 aa, Artificial Sequence
  Description of Artificial Sequence: Synthetic polypeptide
PTPNNQFMMGGRYYNSIGDIIDHYRKEQIVEGYYLKEPVP

SEQ ID NO: 8494 - protein, 40 aa, Artificial Sequence
  Description of Artificial Sequence: Synthetic polypeptide
PNNQFMMGGRYYNSIGDIIDHYRKEQIVEGYYLKEPVPMQ

SEQ ID NO: 8495 - protein, 40 aa, Artificial Sequence
  Description of Artificial Sequence: Synthetic polypeptide
MGGRYYNSIGDIIDHYRKEQIVEGYYLKEPVPMQDQEQVL

SEQ ID NO: 8496 - protein, 40 aa, Artificial Sequence
  Description of Artificial Sequence: Synthetic polypeptide
GGRYYNSIGDIIDHYRKEQIVEGYYLKEPVPMQDQEQVLN

SEQ ID NO: 8497 - protein, 40 aa, Artificial Sequence
  Description of Artificial Sequence: Synthetic polypeptide
RYYNSIGDIIDHYRKEQIVEGYYLKEPVPMQDQEQVLNDT

SEQ ID NO: 8498 - protein, 40 aa, Artificial Sequence
  Description of Artificial Sequence: Synthetic polypeptide
NSIGDIIDHYRKEQIVEGYYLKEPVPMQDQEQVLNDTVDG

SEQ ID NO: 8499 - protein, 40 aa, Artificial Sequence
  Description of Artificial Sequence: Synthetic polypeptide
SIGDIIDHYRKEQIVEGYYLKEPVPMQDQEQVLNDTVDGK

SEQ ID NO: 8500 - protein, 40 aa, Artificial Sequence
  Description of Artificial Sequence: Synthetic polypeptide
DIIDHYRKEQIVEGYYLKEPVPMQDQEQVLNDTVDGKEIY

SEQ ID NO: 8501 - protein, 40 aa, Artificial Sequence
  Description of Artificial Sequence: Synthetic polypeptide
IIDHYRKEQIVEGYYLKEPVPMQDQEQVLNDTVDGKEIYN

SEQ ID NO: 8502 - protein, 40 aa, Artificial Sequence
  Description of Artificial Sequence: Synthetic polypeptide
IDHYRKEQIVEGYYLKEPVPMQDQEQVLNDTVDGKEIYNT

SEQ ID NO: 8503 - protein, 40 aa, Artificial Sequence
  Description of Artificial Sequence: Synthetic polypeptide
RKEQIVEGYYLKEPVPMQDQEQVLNDTVDGKEIYNTIRRK

SEQ ID NO: 8504 - protein, 40 aa, Artificial Sequence
  Description of Artificial Sequence: Synthetic polypeptide
LNDTVDGKEIYNTIRRKTKDAFYKNIVKKGYLLKKGKGKR

SEQ ID NO: 8505 - protein, 40 aa, Artificial Sequence
  Description of Artificial Sequence: Synthetic polypeptide
DTVDGKEIYNTIRRKTKDAFYKNIVKKGYLLKKGKGKRWK

SEQ ID NO: 8506 - protein, 40 aa, Artificial Sequence
  Description of Artificial Sequence: Synthetic polypeptide
LLKKGKGKRWKNLYFILEGSDAQLIYFESEKRATKPKGLI

SEQ ID NO: 8507 - protein, 40 aa, Artificial Sequence
  Description of Artificial Sequence: Synthetic polypeptide
MKKGKGKRWKNLYFILEGSDAQLIYFESEKRATKPKGLID

SEQ ID NO: 8508 - protein, 40 aa, Artificial Sequence
  Description of Artificial Sequence: Synthetic polypeptide
KKGKGKRWKNLYFILEGSDAQLIYFESEKRATKPKGLIDL

SEQ ID NO: 8509 - protein, 40 aa, Artificial Sequence
  Description of Artificial Sequence: Synthetic polypeptide
KGKRWKNLYFILEGSDAQLIYFESEKRATKPKGLIDLSVC

SEQ ID NO: 8510 - protein, 40 aa, Artificial Sequence
  Description of Artificial Sequence: Synthetic polypeptide
KRWKNLYFILEGSDAQLIYFESEKRATKPKGLIDLSVCSV

SEQ ID NO: 8511 - protein, 40 aa, Artificial Sequence
  Description of Artificial Sequence: Synthetic polypeptide
LYFILEGSDAQLIYFESEKRATKPKGLIDLSVCSVYVVHD

SEQ ID NO: 8512 - protein, 40 aa, Artificial Sequence
  Description of Artificial Sequence: Synthetic polypeptide
ILEGSDAQLIYFESEKRATKPKGLIDLSVCSVYVVHDSLF

SEQ ID NO: 8513 - protein, 40 aa, Artificial Sequence
  Description of Artificial Sequence: Synthetic polypeptide
EGSDAQLIYFESEKRATKPKGLIDLSVCSVYVVHDSLFGR

SEQ ID NO: 8514 - protein, 40 aa, Artificial Sequence
  Description of Artificial Sequence: Synthetic polypeptide
SDAQLIYFESEKRATKPKGLIDLSVCSVYVVHDSLFGRPN

SEQ ID NO: 8515 - protein, 40 aa, Artificial Sequence
  Description of Artificial Sequence: Synthetic polypeptide
QLIYFESEKRATKPKGLIDLSVCSVYVVHDSLFGRPNCFQ

SEQ ID NO: 8516 - protein, 40 aa, Artificial Sequence
  Description of Artificial Sequence: Synthetic polypeptide
LIYFESEKRATKPKGLIDLSVCSVYVVHDSLFGRPNCFQI

SEQ ID NO: 8517 - protein, 40 aa, Artificial Sequence
  Description of Artificial Sequence: Synthetic polypeptide
YFESEKRATKPKGLIDLSVCSVYVVHDSLFGRPNCFQIVV

SEQ ID NO: 8518 - protein, 40 aa, Artificial Sequence
  Description of Artificial Sequence: Synthetic polypeptide
FESEKRATKPKGLIDLSVCSVYVVHDSLFGRPNCFQIVVQ

SEQ ID NO: 8519 - protein, 40 aa, Artificial Sequence
  Description of Artificial Sequence: Synthetic polypeptide
EKRATKPKGLIDLSVCSVYVVHDSLFGRPNCFQIVVQHFS

SEQ ID NO: 8520 - protein, 40 aa, Artificial Sequence
  Description of Artificial Sequence: Synthetic polypeptide
ATKPKGLIDLSVCSVYVVHDSLFGRPNCFQIVVQHFSEEH

SEQ ID NO: 8521 - protein, 40 aa, Artificial Sequence
  Description of Artificial Sequence: Synthetic polypeptide
TKPKGLIDLSVCSVYVVHDSLFGRPNCFQIVVQHFSEEHY

SEQ ID NO: 8522 - protein, 40 aa, Artificial Sequence
  Description of Artificial Sequence: Synthetic polypeptide
PKGLIDLSVCSVYVVHDSLFGRPNCFQIVVQHFSEEHYIF

SEQ ID NO: 8523 - protein, 40 aa, Artificial Sequence
  Description of Artificial Sequence: Synthetic polypeptide
KGLIDLSVCSVYVVHDSLFGRPNCFQIVVQHFSEEHYIFY

SEQ ID NO: 8524 - protein, 40 aa, Artificial Sequence
  Description of Artificial Sequence: Synthetic polypeptide
GLIDLSVCSVYVVHDSLFGRPNCFQIVVQHFSEEHYIFYF

SEQ ID NO: 8525 - protein, 40 aa, Artificial Sequence
  Description of Artificial Sequence: Synthetic polypeptide
LIDLSVCSVYVVHDSLFGRPNCFQIVVQHFSEEHYIFYFA

SEQ ID NO: 8526 - protein, 40 aa, Artificial Sequence
  Description of Artificial Sequence: Synthetic polypeptide
IDLSVCSVYVVHDSLFGRPNCFQIVVQHFSEEHYIFYFAG

SEQ ID NO: 8527 - protein, 40 aa, Artificial Sequence
  Description of Artificial Sequence: Synthetic polypeptide
CSVYVVHDSLFGRPNCFQIVVQHFSEEHYIFYFAGETPEQ

SEQ ID NO: 8528 - protein, 40 aa, Artificial Sequence
  Description of Artificial Sequence: Synthetic polypeptide
GRPNCFQIVVQHFSEEHYIFYFAGETPEQAEDWMKGLQAF

SEQ ID NO: 8529 - protein, 40 aa, Artificial Sequence
  Description of Artificial Sequence: Synthetic polypeptide
CFQIVVQHFSEEHYIFYFAGETPEQAEDWMKGLQAFCNLR

SEQ ID NO: 8530 - protein, 40 aa, Artificial Sequence
  Description of Artificial Sequence: Synthetic polypeptide
FSEEHYIFYFAGETPEQAEDWMKGLQAFCNLRKSSPGTSN

SEQ ID NO: 8531 - protein, 40 aa, Artificial Sequence
  Description of Artificial Sequence: Synthetic polypeptide
EEHYIFYFAGETPEQAEDWMKGLQAFCNLRKSSPGTSNKR

SEQ ID NO: 8532 - protein, 40 aa, Artificial Sequence
  Description of Artificial Sequence: Synthetic polypeptide
EHYIFYFAGETPEQAEDWMKGLQAFCNLRKSSPGTSNKRL

SEQ ID NO: 8533 - protein, 40 aa, Artificial Sequence
  Description of Artificial Sequence: Synthetic polypeptide
GETPEQAEDWMKGLQAFCNLRKSSPGTSNKRLRQVSSLVL

SEQ ID NO: 8534 - protein, 40 aa, Artificial Sequence
  Description of Artificial Sequence: Synthetic polypeptide
ETPEQAEDWMKGLQAFCNLRKSSPGTSNKRLRQVSSLVLH

SEQ ID NO: 8535 - protein, 40 aa, Artificial Sequence
  Description of Artificial Sequence: Synthetic polypeptide
TPEQAEDWMKGLQAFCNLRKSSPGTSNKRLRQVSSLVLHI

SEQ ID NO: 8536 - protein, 40 aa, Artificial Sequence
  Description of Artificial Sequence: Synthetic polypeptide
QAEDWMKGLQAFCNLRKSSPGTSNKRLRQVSSLVLHIEEA

SEQ ID NO: 8537 - protein, 40 aa, Artificial Sequence
  Description of Artificial Sequence: Synthetic polypeptide
EDWMKGLQAFCNLRKSSPGTSNKRLRQVSSLVLHIEEAHK

SEQ ID NO: 8538 - protein, 40 aa, Artificial Sequence
  Description of Artificial Sequence: Synthetic polypeptide
DWMKGLQAFCNLRKSSPGTSNKRLRQVSSLVLHIEEAHKL

SEQ ID NO: 8539 - protein, 40 aa, Artificial Sequence
  Description of Artificial Sequence: Synthetic polypeptide
KGLQAFCNLRKSSPGTSNKRLRQVSSLVLHIEEAHKLPVK

SEQ ID NO: 8540 - protein, 40 aa, Artificial Sequence
  Description of Artificial Sequence: Synthetic polypeptide
MQAFCNLRKSSPGTSNKRLRQVSSLVLHIEEAHKLPVKHF

SEQ ID NO: 8541 - protein, 40 aa, Artificial Sequence
  Description of Artificial Sequence: Synthetic polypeptide
QAFCNLRKSSPGTSNKRLRQVSSLVLHIEEAHKLPVKHFT

SEQ ID NO: 8542 - protein, 40 aa, Artificial Sequence
  Description of Artificial Sequence: Synthetic polypeptide
KSSPGTSNKRLRQVSSLVLHIEEAHKLPVKHFTNPYCNIY

SEQ ID NO: 8543 - protein, 40 aa, Artificial Sequence
  Description of Artificial Sequence: Synthetic polypeptide
PGTSNKRLRQVSSLVLHIEEAHKLPVKHFTNPYCNIYLNS

SEQ ID NO: 8544 - protein, 40 aa, Artificial Sequence
  Description of Artificial Sequence: Synthetic polypeptide
KRLRQVSSLVLHIEEAHKLPVKHFTNPYCNIYLNSVQVAK

SEQ ID NO: 8545 - protein, 40 aa, Artificial Sequence
  Description of Artificial Sequence: Synthetic polypeptide
RQVSSLVLHIEEAHKLPVKHFTNPYCNIYLNSVQVAKTHA

SEQ ID NO: 8546 - protein, 40 aa, Artificial Sequence
  Description of Artificial Sequence: Synthetic polypeptide
QVSSLVLHIEEAHKLPVKHFTNPYCNIYLNSVQVAKTHAR

SEQ ID NO: 8547 - protein, 40 aa, Artificial Sequence
  Description of Artificial Sequence: Synthetic polypeptide
VSSLVLHIEEAHKLPVKHFTNPYCNIYLNSVQVAKTHARE

SEQ ID NO: 8548 - protein, 40 aa, Artificial Sequence
  Description of Artificial Sequence: Synthetic polypeptide
SSLVLHIEEAHKLPVKHFTNPYCNIYLNSVQVAKTHAREG

SEQ ID NO: 8549 - protein, 40 aa, Artificial Sequence
  Description of Artificial Sequence: Synthetic polypeptide
SLVLHIEEAHKLPVKHFTNPYCNIYLNSVQVAKTHAREGQ

SEQ ID NO: 8550 - protein, 40 aa, Artificial Sequence
  Description of Artificial Sequence: Synthetic polypeptide
LVLHIEEAHKLPVKHFTNPYCNIYLNSVQVAKTHAREGQN

SEQ ID NO: 8551 - protein, 40 aa, Artificial Sequence
  Description of Artificial Sequence: Synthetic polypeptide
LHIEEAHKLPVKHFTNPYCNIYLNSVQVAKTHAREGQNPV

SEQ ID NO: 8552 - protein, 40 aa, Artificial Sequence
  Description of Artificial Sequence: Synthetic polypeptide
HIEEAHKLPVKHFTNPYCNIYLNSVQVAKTHAREGQNPVW

SEQ ID NO: 8553 - protein, 40 aa, Artificial Sequence
  Description of Artificial Sequence: Synthetic polypeptide
IEEAHKLPVKHFTNPYCNIYLNSVQVAKTHAREGQNPVWS

SEQ ID NO: 8554 - protein, 40 aa, Artificial Sequence
  Description of Artificial Sequence: Synthetic polypeptide
PVKHFTNPYCNIYLNSVQVAKTHAREGQNPVWSEEFVFDD

SEQ ID NO: 8555 - protein, 40 aa, Artificial Sequence
  Description of Artificial Sequence: Synthetic polypeptide
AREGQNPVWSEEFVFDDLPPDINRFEITLSNKTKKSKDPD

SEQ ID NO: 8556 - protein, 40 aa, Artificial Sequence
  Description of Artificial Sequence: Synthetic polypeptide
REGQNPVWSEEFVFDDLPPDINRFEITLSNKTKKSKDPDI

SEQ ID NO: 8557 - protein, 40 aa, Artificial Sequence
  Description of Artificial Sequence: Synthetic polypeptide
EGQNPVWSEEFVFDDLPPDINRFEITLSNKTKKSKDPDIL

SEQ ID NO: 8558 - protein, 40 aa, Artificial Sequence
  Description of Artificial Sequence: Synthetic polypeptide
NPVWSEEFVFDDLPPDINRFEITLSNKTKKSKDPDILFMR

SEQ ID NO: 8559 - protein, 40 aa, Artificial Sequence
  Description of Artificial Sequence: Synthetic polypeptide
EITLSNKTKKSKDPDILFMRCQLSRLQKGHATDEWFLLSS

SEQ ID NO: 8560 - protein, 40 aa, Artificial Sequence
  Description of Artificial Sequence: Synthetic polypeptide
ITLSNKTKKSKDPDILFMRCQLSRLQKGHATDEWFLLSSH

SEQ ID NO: 8561 - protein, 40 aa, Artificial Sequence
  Description of Artificial Sequence: Synthetic polypeptide
TLSNKTKKSKDPDILFMRCQLSRLQKGHATDEWFLLSSHI

SEQ ID NO: 8562 - protein, 40 aa, Artificial Sequence
  Description of Artificial Sequence: Synthetic polypeptide
NKTKKSKDPDILFMRCQLSRLQKGHATDEWFLLSSHIPLK

SEQ ID NO: 8563 - protein, 40 aa, Artificial Sequence
  Description of Artificial Sequence: Synthetic polypeptide
TKKSKDPDILFMRCQLSRLQKGHATDEWFLLSSHIPLKGI

SEQ ID NO: 8564 - protein, 40 aa, Artificial Sequence
  Description of Artificial Sequence: Synthetic polypeptide
SKDPDILFMRCQLSRLQKGHATDEWFLLSSHIPLKGIEPG

SEQ ID NO: 8565 - protein, 40 aa, Artificial Sequence
  Description of Artificial Sequence: Synthetic polypeptide
DPDILFMRCQLSRLQKGHATDEWFLLSSHIPLKGIEPGSL

SEQ ID NO: 8566 - protein, 40 aa, Artificial Sequence
  Description of Artificial Sequence: Synthetic polypeptide
DILFMRCQLSRLQKGHATDEWFLLSSHIPLKGIEPGSLRV

SEQ ID NO: 8567 - protein, 40 aa, Artificial Sequence
  Description of Artificial Sequence: Synthetic polypeptide
ILFMRCQLSRLQKGHATDEWFLLSSHIPLKGIEPGSLRVR

SEQ ID NO: 8568 - protein, 40 aa, Artificial Sequence
  Description of Artificial Sequence: Synthetic polypeptide
LFMRCQLSRLQKGHATDEWFLLSSHIPLKGIEPGSLRVRA

SEQ ID NO: 8569 - protein, 40 aa, Artificial Sequence
  Description of Artificial Sequence: Synthetic polypeptide
QLSRLQKGHATDEWFLLSSHIPLKGIEPGSLRVRARYSME

SEQ ID NO: 8570 - protein, 40 aa, Artificial Sequence
  Description of Artificial Sequence: Synthetic polypeptide
LQKGHATDEWFLLSSHIPLKGIEPGSLRVRARYSMEKIMP

SEQ ID NO: 8571 - protein, 40 aa, Artificial Sequence
  Description of Artificial Sequence: Synthetic polypeptide
LSSHIPLKGIEPGSLRVRARYSMEKIMPEEEYSEFKELIL

SEQ ID NO: 8572 - protein, 40 aa, Artificial Sequence
  Description of Artificial Sequence: Synthetic polypeptide
SHIPLKGIEPGSLRVRARYSMEKIMPEEEYSEFKELILQK

SEQ ID NO: 8573 - protein, 40 aa, Artificial Sequence
  Description of Artificial Sequence: Synthetic polypeptide
IPLKGIEPGSLRVRARYSMEKIMPEEEYSEFKELILQKEL

SEQ ID NO: 8574 - protein, 40 aa, Artificial Sequence
  Description of Artificial Sequence: Synthetic polypeptide
PLKGIEPGSLRVRARYSMEKIMPEEEYSEFKELILQKELH

SEQ ID NO: 8575 - protein, 40 aa, Artificial Sequence
  Description of Artificial Sequence: Synthetic polypeptide
IEPGSLRVRARYSMEKIMPEEEYSEFKELILQKELHVVYA

SEQ ID NO: 8576 - protein, 40 aa, Artificial Sequence
  Description of Artificial Sequence: Synthetic polypeptide
PGSLRVRARYSMEKIMPEEEYSEFKELILQKELHVVYALS

SEQ ID NO: 8577 - protein, 40 aa, Artificial Sequence
  Description of Artificial Sequence: Synthetic polypeptide
GSLRVRARYSMEKIMPEEEYSEFKELILQKELHVVYALSH

SEQ ID NO: 8578 - protein, 40 aa, Artificial Sequence
  Description of Artificial Sequence: Synthetic polypeptide
RYSMEKIMPEEEYSEFKELILQKELHVVYALSHVCGQDRT

SEQ ID NO: 8579 - protein, 40 aa, Artificial Sequence
  Description of Artificial Sequence: Synthetic polypeptide
PEEEYSEFKELILQKELHVVYALSHVCGQDRTLLASILLR

SEQ ID NO: 8580 - protein, 40 aa, Artificial Sequence
  Description of Artificial Sequence: Synthetic polypeptide
YALSHVCGQDRTLLASILLRIFLHEKLESLLLCTLNDREI

SEQ ID NO: 8581 - protein, 40 aa, Artificial Sequence
  Description of Artificial Sequence: Synthetic polypeptide
DRTLLASILLRIFLHEKLESLLLCTLNDREISMEDEATTL

SEQ ID NO: 8582 - protein, 40 aa, Artificial Sequence
  Description of Artificial Sequence: Synthetic polypeptide
LFRATTLASTLMEQYMKATATQFVHHALKDSILKIMESKQ

SEQ ID NO: 8583 - protein, 40 aa, Artificial Sequence
  Description of Artificial Sequence: Synthetic polypeptide
TLASTLMEQYMKATATQFVHHALKDSILKIMESKQSCELS

SEQ ID NO: 8584 - protein, 40 aa, Artificial Sequence
  Description of Artificial Sequence: Synthetic polypeptide
EQYMKATATQFVHHALKDSILKIMESKQSCELSPSKLEKN

SEQ ID NO: 8585 - protein, 40 aa, Artificial Sequence
  Description of Artificial Sequence: Synthetic polypeptide
YMKATATQFVHHALKDSILKIMESKQSCELSPSKLEKNED

SEQ ID NO: 8586 - protein, 40 aa, Artificial Sequence
  Description of Artificial Sequence: Synthetic polypeptide
TATQFVHHALKDSILKIMESKQSCELSPSKLEKNEDVNTN

SEQ ID NO: 8587 - protein, 40 aa, Artificial Sequence
  Description of Artificial Sequence: Synthetic polypeptide
ATQFVHHALKDSILKIMESKQSCELSPSKLEKNEDVNTNL

SEQ ID NO: 8588 - protein, 40 aa, Artificial Sequence
  Description of Artificial Sequence: Synthetic polypeptide
HHALKDSILKIMESKQSCELSPSKLEKNEDVNTNLTHLLN

SEQ ID NO: 8589 - protein, 40 aa, Artificial Sequence
  Description of Artificial Sequence: Synthetic polypeptide
HALKDSILKIMESKQSCELSPSKLEKNEDVNTNLTHLLNI

SEQ ID NO: 8590 - protein, 40 aa, Artificial Sequence
  Description of Artificial Sequence: Synthetic polypeptide
MKDSILKIMESKQSCELSPSKLEKNEDVNTNLTHLLNILS

SEQ ID NO: 8591 - protein, 40 aa, Artificial Sequence
  Description of Artificial Sequence: Synthetic polypeptide
KDSILKIMESKQSCELSPSKLEKNEDVNTNLTHLLNILSE

SEQ ID NO: 8592 - protein, 40 aa, Artificial Sequence
  Description of Artificial Sequence: Synthetic polypeptide
DSILKIMESKQSCELSPSKLEKNEDVNTNLTHLLNILSEL

SEQ ID NO: 8593 - protein, 40 aa, Artificial Sequence
  Description of Artificial Sequence: Synthetic polypeptide
LKIMESKQSCELSPSKLEKNEDVNTNLTHLLNILSELVEK

SEQ ID NO: 8594 - protein, 40 aa, Artificial Sequence
  Description of Artificial Sequence: Synthetic polypeptide
KIMESKQSCELSPSKLEKNEDVNTNLTHLLNILSELVEKI

SEQ ID NO: 8595 - protein, 40 aa, Artificial Sequence
  Description of Artificial Sequence: Synthetic polypeptide
SCELSPSKLEKNEDVNTNLTHLLNILSELVEKIFMASEIL

SEQ ID NO: 8596 - protein, 40 aa, Artificial Sequence
  Description of Artificial Sequence: Synthetic polypeptide
SKLEKNEDVNTNLTHLLNILSELVEKIFMASEILPPTLRY

SEQ ID NO: 8597 - protein, 40 aa, Artificial Sequence
  Description of Artificial Sequence: Synthetic polypeptide
KLEKNEDVNTNLTHLLNILSELVEKIFMASEILPPTLRYI

SEQ ID NO: 8598 - protein, 40 aa, Artificial Sequence
  Description of Artificial Sequence: Synthetic polypeptide
LEKNEDVNTNLTHLLNILSELVEKIFMASEILPPTLRYIY

SEQ ID NO: 8599 - protein, 40 aa, Artificial Sequence
  Description of Artificial Sequence: Synthetic polypeptide
NEDVNTNLTHLLNILSELVEKIFMASEILPPTLRYIYGCL

SEQ ID NO: 8600 - protein, 40 aa, Artificial Sequence
  Description of Artificial Sequence: Synthetic polypeptide
NLTHLLNILSELVEKIFMASEILPPTLRYIYGCLQKSVQH

SEQ ID NO: 8601 - protein, 40 aa, Artificial Sequence
  Description of Artificial Sequence: Synthetic polypeptide
HLLNILSELVEKIFMASEILPPTLRYIYGCLQKSVQHKWP

SEQ ID NO: 8602 - protein, 40 aa, Artificial Sequence
  Description of Artificial Sequence: Synthetic polypeptide
MNILSELVEKIFMASEILPPTLRYIYGCLQKSVQHKWPTN

SEQ ID NO: 8603 - protein, 40 aa, Artificial Sequence
  Description of Artificial Sequence: Synthetic polypeptide
SELVEKIFMASEILPPTLRYIYGCLQKSVQHKWPTNTTMR

SEQ ID NO: 8604 - protein, 40 aa, Artificial Sequence
  Description of Artificial Sequence: Synthetic polypeptide
LVEKIFMASEILPPTLRYIYGCLQKSVQHKWPTNTTMRTR

SEQ ID NO: 8605 - protein, 40 aa, Artificial Sequence
  Description of Artificial Sequence: Synthetic polypeptide
VEKIFMASEILPPTLRYIYGCLQKSVQHKWPTNTTMRTRV

SEQ ID NO: 8606 - protein, 40 aa, Artificial Sequence
  Description of Artificial Sequence: Synthetic polypeptide
IFMASEILPPTLRYIYGCLQKSVQHKWPTNTTMRTRVVSG

SEQ ID NO: 8607 - protein, 40 aa, Artificial Sequence
  Description of Artificial Sequence: Synthetic polypeptide
ASEILPPTLRYIYGCLQKSVQHKWPTNTTMRTRVVSGFVF

SEQ ID NO: 8608 - protein, 40 aa, Artificial Sequence
  Description of Artificial Sequence: Synthetic polypeptide
SEILPPTLRYIYGCLQKSVQHKWPTNTTMRTRVVSGFVFL

SEQ ID NO: 8609 - protein, 40 aa, Artificial Sequence
  Description of Artificial Sequence: Synthetic polypeptide
ILPPTLRYIYGCLQKSVQHKWPTNTTMRTRVVSGFVFLRL

SEQ ID NO: 8610 - protein, 40 aa, Artificial Sequence
  Description of Artificial Sequence: Synthetic polypeptide
PPTLRYIYGCLQKSVQHKWPTNTTMRTRVVSGFVFLRLIC

SEQ ID NO: 8611 - protein, 40 aa, Artificial Sequence
  Description of Artificial Sequence: Synthetic polypeptide
TLRYIYGCLQKSVQHKWPTNTTMRTRVVSGFVFLRLICPA

SEQ ID NO: 8612 - protein, 40 aa, Artificial Sequence
  Description of Artificial Sequence: Synthetic polypeptide
MRYIYGCLQKSVQHKWPTNTTMRTRVVSGFVFLRLICPAI

SEQ ID NO: 8613 - protein, 40 aa, Artificial Sequence
  Description of Artificial Sequence: Synthetic polypeptide
RYIYGCLQKSVQHKWPTNTTMRTRVVSGFVFLRLICPAIL

SEQ ID NO: 8614 - protein, 40 aa, Artificial Sequence
  Description of Artificial Sequence: Synthetic polypeptide
YIYGCLQKSVQHKWPTNTTMRTRVVSGFVFLRLICPAILN

SEQ ID NO: 8615 - protein, 40 aa, Artificial Sequence
  Description of Artificial Sequence: Synthetic polypeptide
IMFLDELGNVPELPDTTEHSRTDLSRDLAALHEICVAHSD

SEQ ID NO: 8616 - protein, 40 aa, Artificial Sequence
  Description of Artificial Sequence: Synthetic polypeptide
SRDLAALHEICVAHSDELRTLSNERGAQQHVLKKLLAITE

SEQ ID NO: 8617 - protein, 40 aa, Artificial Sequence
  Description of Artificial Sequence: Synthetic polypeptide
HEICVAHSDELRTLSNERGAQQHVLKKLLAITELLQQKQN

SEQ ID NO: 8618 - protein, 40 aa, Artificial Sequence
  Description of Artificial Sequence: Synthetic polypeptide
HSDELRTLSNERGAQQHVLKKLLAITELLQQKQNQYTKTN

SEQ ID NO: 8619 - protein, 40 aa, Artificial Sequence
  Description of Artificial Sequence: Synthetic polypeptide
SDELRTLSNERGAQQHVLKKLLAITELLQQKQNQYTKTND

SEQ ID NO: 8620 - protein, 40 aa, Artificial Sequence
  Description of Artificial Sequence: Synthetic polypeptide
ELRTLSNERGAQQHVLKKLLAITELLQQKQNQYTKTNDVR

SEQ ID NO: 8621 - protein, 40 aa, Artificial Sequence
  Description of Artificial Sequence: Synthetic polypeptide
EPPAPPPPPPPEEDPEQDSGPEDLPLVRLEFEETEEPDFT

SEQ ID NO: 8622 - protein, 40 aa, Artificial Sequence
  Description of Artificial Sequence: Synthetic polypeptide
CQKLKIPDHVRERAWLTWEKVSSVDGVLGGYIQKKKELWG

SEQ ID NO: 8623 - protein, 40 aa, Artificial Sequence
  Description of Artificial Sequence: Synthetic polypeptide
KLKIPDHVRERAWLTWEKVSSVDGVLGGYIQKKKELWGIC

SEQ ID NO: 8624 - protein, 40 aa, Artificial Sequence
  Description of Artificial Sequence: Synthetic polypeptide
LKIPDHVRERAWLTWEKVSSVDGVLGGYIQKKKELWGICI

SEQ ID NO: 8625 - protein, 40 aa, Artificial Sequence
  Description of Artificial Sequence: Synthetic polypeptide
IPDHVRERAWLTWEKVSSVDGVLGGYIQKKKELWGICIFI

SEQ ID NO: 8626 - protein, 40 aa, Artificial Sequence
  Description of Artificial Sequence: Synthetic polypeptide
PDHVRERAWLTWEKVSSVDGVLGGYIQKKKELWGICIFIA

SEQ ID NO: 8627 - protein, 40 aa, Artificial Sequence
  Description of Artificial Sequence: Synthetic polypeptide
DHVRERAWLTWEKVSSVDGVLGGYIQKKKELWGICIFIAA

SEQ ID NO: 8628 - protein, 40 aa, Artificial Sequence
  Description of Artificial Sequence: Synthetic polypeptide
VRERAWLTWEKVSSVDGVLGGYIQKKKELWGICIFIAAVD

SEQ ID NO: 8629 - protein, 40 aa, Artificial Sequence
  Description of Artificial Sequence: Synthetic polypeptide
RERAWLTWEKVSSVDGVLGGYIQKKKELWGICIFIAAVDL

SEQ ID NO: 8630 - protein, 40 aa, Artificial Sequence
  Description of Artificial Sequence: Synthetic polypeptide
RAWLTWEKVSSVDGVLGGYIQKKKELWGICIFIAAVDLDE

SEQ ID NO: 8631 - protein, 40 aa, Artificial Sequence
  Description of Artificial Sequence: Synthetic polypeptide
WLTWEKVSSVDGVLGGYIQKKKELWGICIFIAAVDLDEMS

SEQ ID NO: 8632 - protein, 40 aa, Artificial Sequence
  Description of Artificial Sequence: Synthetic polypeptide
TWEKVSSVDGVLGGYIQKKKELWGICIFIAAVDLDEMSFT

SEQ ID NO: 8633 - protein, 40 aa, Artificial Sequence
  Description of Artificial Sequence: Synthetic polypeptide
WEKVSSVDGVLGGYIQKKKELWGICIFIAAVDLDEMSFTF

SEQ ID NO: 8634 - protein, 40 aa, Artificial Sequence
  Description of Artificial Sequence: Synthetic polypeptide
EKVSSVDGVLGGYIQKKKELWGICIFIAAVDLDEMSFTFT

SEQ ID NO: 8635 - protein, 40 aa, Artificial Sequence
  Description of Artificial Sequence: Synthetic polypeptide
KVSSVDGVLGGYIQKKKELWGICIFIAAVDLDEMSFTFTE

SEQ ID NO: 8636 - protein, 40 aa, Artificial Sequence
  Description of Artificial Sequence: Synthetic polypeptide
SVDGVLGGYIQKKKELWGICIFIAAVDLDEMSFTFTELQK

SEQ ID NO: 8637 - protein, 40 aa, Artificial Sequence
  Description of Artificial Sequence: Synthetic polypeptide
QKKKELWGICIFIAAVDLDEMSFTFTELQKNIEISVHKFF

SEQ ID NO: 8638 - protein, 40 aa, Artificial Sequence
  Description of Artificial Sequence: Synthetic polypeptide
KKKELWGICIFIAAVDLDEMSFTFTELQKNIEISVHKFFN

SEQ ID NO: 8639 - protein, 40 aa, Artificial Sequence
  Description of Artificial Sequence: Synthetic polypeptide
KKELWGICIFIAAVDLDEMSFTFTELQKNIEISVHKFFNL

SEQ ID NO: 8640 - protein, 40 aa, Artificial Sequence
  Description of Artificial Sequence: Synthetic polypeptide
KELWGICIFIAAVDLDEMSFTFTELQKNIEISVHKFFNLL

SEQ ID NO: 8641 - protein, 40 aa, Artificial Sequence
  Description of Artificial Sequence: Synthetic polypeptide
MWGICIFIAAVDLDEMSFTFTELQKNIEISVHKFFNLLKE

SEQ ID NO: 8642 - protein, 40 aa, Artificial Sequence
  Description of Artificial Sequence: Synthetic polypeptide
WGICIFIAAVDLDEMSFTFTELQKNIEISVHKFFNLLKEI

SEQ ID NO: 8643 - protein, 40 aa, Artificial Sequence
  Description of Artificial Sequence: Synthetic polypeptide
GICIFIAAVDLDEMSFTFTELQKNIEISVHKFFNLLKEID

SEQ ID NO: 8644 - protein, 40 aa, Artificial Sequence
  Description of Artificial Sequence: Synthetic polypeptide
ICIFIAAVDLDEMSFTFTELQKNIEISVHKFFNLLKEIDT

SEQ ID NO: 8645 - protein, 40 aa, Artificial Sequence
  Description of Artificial Sequence: Synthetic polypeptide
FIAAVDLDEMSFTFTELQKNIEISVHKFFNLLKEIDTSTK

SEQ ID NO: 8646 - protein, 40 aa, Artificial Sequence
  Description of Artificial Sequence: Synthetic polypeptide
IAAVDLDEMSFTFTELQKNIEISVHKFFNLLKEIDTSTKV

SEQ ID NO: 8647 - protein, 40 aa, Artificial Sequence
  Description of Artificial Sequence: Synthetic polypeptide
AAVDLDEMSFTFTELQKNIEISVHKFFNLLKEIDTSTKVD

SEQ ID NO: 8648 - protein, 40 aa, Artificial Sequence
  Description of Artificial Sequence: Synthetic polypeptide
AVDLDEMSFTFTELQKNIEISVHKFFNLLKEIDTSTKVDN

SEQ ID NO: 8649 - protein, 40 aa, Artificial Sequence
  Description of Artificial Sequence: Synthetic polypeptide
DLDEMSFTFTELQKNIEISVHKFFNLLKEIDTSTKVDNAM

SEQ ID NO: 8650 - protein, 40 aa, Artificial Sequence
  Description of Artificial Sequence: Synthetic polypeptide
LDEMSFTFTELQKNIEISVHKFFNLLKEIDTSTKVDNAMS

SEQ ID NO: 8651 - protein, 40 aa, Artificial Sequence
  Description of Artificial Sequence: Synthetic polypeptide
DEMSFTFTELQKNIEISVHKFFNLLKEIDTSTKVDNAMSR

SEQ ID NO: 8652 - protein, 40 aa, Artificial Sequence
  Description of Artificial Sequence: Synthetic polypeptide
MSFTFTELQKNIEISVHKFFNLLKEIDTSTKVDNAMSRLL

SEQ ID NO: 8653 - protein, 40 aa, Artificial Sequence
  Description of Artificial Sequence: Synthetic polypeptide
SFTFTELQKNIEISVHKFFNLLKEIDTSTKVDNAMSRLLK

SEQ ID NO: 8654 - protein, 40 aa, Artificial Sequence
  Description of Artificial Sequence: Synthetic polypeptide
FTFTELQKNIEISVHKFFNLLKEIDTSTKVDNAMSRLLKK

SEQ ID NO: 8655 - protein, 40 aa, Artificial Sequence
  Description of Artificial Sequence: Synthetic polypeptide
TFTELQKNIEISVHKFFNLLKEIDTSTKVDNAMSRLLKKY

SEQ ID NO: 8656 - protein, 40 aa, Artificial Sequence
  Description of Artificial Sequence: Synthetic polypeptide
ELQKNIEISVHKFFNLLKEIDTSTKVDNAMSRLLKKYDVL

SEQ ID NO: 8657 - protein, 40 aa, Artificial Sequence
  Description of Artificial Sequence: Synthetic polypeptide
LQKNIEISVHKFFNLLKEIDTSTKVDNAMSRLLKKYDVLF

SEQ ID NO: 8658 - protein, 40 aa, Artificial Sequence
  Description of Artificial Sequence: Synthetic polypeptide
QKNIEISVHKFFNLLKEIDTSTKVDNAMSRLLKKYDVLFA

SEQ ID NO: 8659 - protein, 40 aa, Artificial Sequence
  Description of Artificial Sequence: Synthetic polypeptide
KNIEISVHKFFNLLKEIDTSTKVDNAMSRLLKKYDVLFAL

SEQ ID NO: 8660 - protein, 40 aa, Artificial Sequence
  Description of Artificial Sequence: Synthetic polypeptide
NIEISVHKFFNLLKEIDTSTKVDNAMSRLLKKYDVLFALF

SEQ ID NO: 8661 - protein, 40 aa, Artificial Sequence
  Description of Artificial Sequence: Synthetic polypeptide
IEISVHKFFNLLKEIDTSTKVDNAMSRLLKKYDVLFALFS

SEQ ID NO: 8662 - protein, 40 aa, Artificial Sequence
  Description of Artificial Sequence: Synthetic polypeptide
ISVHKFFNLLKEIDTSTKVDNAMSRLLKKYDVLFALFSKL

SEQ ID NO: 8663 - protein, 40 aa, Artificial Sequence
  Description of Artificial Sequence: Synthetic polypeptide
SVHKFFNLLKEIDTSTKVDNAMSRLLKKYDVLFALFSKLE

SEQ ID NO: 8664 - protein, 40 aa, Artificial Sequence
  Description of Artificial Sequence: Synthetic polypeptide
HKFFNLLKEIDTSTKVDNAMSRLLKKYDVLFALFSKLERT

SEQ ID NO: 8665 - protein, 40 aa, Artificial Sequence
  Description of Artificial Sequence: Synthetic polypeptide
EIDTSTKVDNAMSRLLKKYDVLFALFSKLERTCELIYLTQ

SEQ ID NO: 8666 - protein, 40 aa, Artificial Sequence
  Description of Artificial Sequence: Synthetic polypeptide
SRLLKKYDVLFALFSKLERTCELIYLTQPSSSISTEINSA

SEQ ID NO: 8667 - protein, 40 aa, Artificial Sequence
  Description of Artificial Sequence: Synthetic polypeptide
KKYDVLFALFSKLERTCELIYLTQPSSSISTEINSALVLK

SEQ ID NO: 8668 - protein, 40 aa, Artificial Sequence
  Description of Artificial Sequence: Synthetic polypeptide
YDVLFALFSKLERTCELIYLTQPSSSISTEINSALVLKVS

SEQ ID NO: 8669 - protein, 40 aa, Artificial Sequence
  Description of Artificial Sequence: Synthetic polypeptide
DVLFALFSKLERTCELIYLTQPSSSISTEINSALVLKVSW

SEQ ID NO: 8670 - protein, 40 aa, Artificial Sequence
  Description of Artificial Sequence: Synthetic polypeptide
VLFALFSKLERTCELIYLTQPSSSISTEINSALVLKVSWI

SEQ ID NO: 8671 - protein, 40 aa, Artificial Sequence
  Description of Artificial Sequence: Synthetic polypeptide
ALFSKLERTCELIYLTQPSSSISTEINSALVLKVSWITFL

SEQ ID NO: 8672 - protein, 40 aa, Artificial Sequence
  Description of Artificial Sequence: Synthetic polypeptide
FSKLERTCELIYLTQPSSSISTEINSALVLKVSWITFLLA

SEQ ID NO: 8673 - protein, 40 aa, Artificial Sequence
  Description of Artificial Sequence: Synthetic polypeptide
PSSSISTEINSALVLKVSWITFLLAKGEVLQMEDDLVISF

SEQ ID NO: 8674 - protein, 40 aa, Artificial Sequence
  Description of Artificial Sequence: Synthetic polypeptide
SSISTEINSALVLKVSWITFLLAKGEVLQMEDDLVISFQL

SEQ ID NO: 8675 - protein, 40 aa, Artificial Sequence
  Description of Artificial Sequence: Synthetic polypeptide
ISTEINSALVLKVSWITFLLAKGEVLQMEDDLVISFQLML

SEQ ID NO: 8676 - protein, 40 aa, Artificial Sequence
  Description of Artificial Sequence: Synthetic polypeptide
TEINSALVLKVSWITFLLAKGEVLQMEDDLVISFQLMLCV

SEQ ID NO: 8677 - protein, 40 aa, Artificial Sequence
  Description of Artificial Sequence: Synthetic polypeptide
INSALVLKVSWITFLLAKGEVLQMEDDLVISFQLMLCVLD

SEQ ID NO: 8678 - protein, 40 aa, Artificial Sequence
  Description of Artificial Sequence: Synthetic polypeptide
NSALVLKVSWITFLLAKGEVLQMEDDLVISFQLMLCVLDY

SEQ ID NO: 8679 - protein, 40 aa, Artificial Sequence
  Description of Artificial Sequence: Synthetic polypeptide
SALVLKVSWITFLLAKGEVLQMEDDLVISFQLMLCVLDYF

SEQ ID NO: 8680 - protein, 40 aa, Artificial Sequence
  Description of Artificial Sequence: Synthetic polypeptide
VSWITFLLAKGEVLQMEDDLVISFQLMLCVLDYFIKLSPP

SEQ ID NO: 8681 - protein, 40 aa, Artificial Sequence
  Description of Artificial Sequence: Synthetic polypeptide
SWITFLLAKGEVLQMEDDLVISFQLMLCVLDYFIKLSPPM

SEQ ID NO: 8682 - protein, 40 aa, Artificial Sequence
  Description of Artificial Sequence: Synthetic polypeptide
WITFLLAKGEVLQMEDDLVISFQLMLCVLDYFIKLSPPML

SEQ ID NO: 8683 - protein, 40 aa, Artificial Sequence
  Description of Artificial Sequence: Synthetic polypeptide
ITFLLAKGEVLQMEDDLVISFQLMLCVLDYFIKLSPPMLL

SEQ ID NO: 8684 - protein, 40 aa, Artificial Sequence
  Description of Artificial Sequence: Synthetic polypeptide
TFLLAKGEVLQMEDDLVISFQLMLCVLDYFIKLSPPMLLK

SEQ ID NO: 8685 - protein, 40 aa, Artificial Sequence
  Description of Artificial Sequence: Synthetic polypeptide
FLLAKGEVLQMEDDLVISFQLMLCVLDYFIKLSPPMLLKE

SEQ ID NO: 8686 - protein, 40 aa, Artificial Sequence
  Description of Artificial Sequence: Synthetic polypeptide
LLAKGEVLQMEDDLVISFQLMLCVLDYFIKLSPPMLLKEP

SEQ ID NO: 8687 - protein, 40 aa, Artificial Sequence
  Description of Artificial Sequence: Synthetic polypeptide
LAKGEVLQMEDDLVISFQLMLCVLDYFIKLSPPMLLKEPY

SEQ ID NO: 8688 - protein, 40 aa, Artificial Sequence
  Description of Artificial Sequence: Synthetic polypeptide
KGEVLQMEDDLVISFQLMLCVLDYFIKLSPPMLLKEPYKT

SEQ ID NO: 8689 - protein, 40 aa, Artificial Sequence
  Description of Artificial Sequence: Synthetic polypeptide
GEVLQMEDDLVISFQLMLCVLDYFIKLSPPMLLKEPYKTA

SEQ ID NO: 8690 - protein, 40 aa, Artificial Sequence
  Description of Artificial Sequence: Synthetic polypeptide
EVLQMEDDLVISFQLMLCVLDYFIKLSPPMLLKEPYKTAV

SEQ ID NO: 8691 - protein, 40 aa, Artificial Sequence
  Description of Artificial Sequence: Synthetic polypeptide
VLQMEDDLVISFQLMLCVLDYFIKLSPPMLLKEPYKTAVI

SEQ ID NO: 8692 - protein, 40 aa, Artificial Sequence
  Description of Artificial Sequence: Synthetic polypeptide
DDLVISFQLMLCVLDYFIKLSPPMLLKEPYKTAVIPINGS

SEQ ID NO: 8693 - protein, 40 aa, Artificial Sequence
  Description of Artificial Sequence: Synthetic polypeptide
MVISFQLMLCVLDYFIKLSPPMLLKEPYKTAVIPINGSPR

SEQ ID NO: 8694 - protein, 40 aa, Artificial Sequence
  Description of Artificial Sequence: Synthetic polypeptide
VISFQLMLCVLDYFIKLSPPMLLKEPYKTAVIPINGSPRT

SEQ ID NO: 8695 - protein, 40 aa, Artificial Sequence
  Description of Artificial Sequence: Synthetic polypeptide
ISFQLMLCVLDYFIKLSPPMLLKEPYKTAVIPINGSPRTP

SEQ ID NO: 8696 - protein, 40 aa, Artificial Sequence
  Description of Artificial Sequence: Synthetic polypeptide
SFQLMLCVLDYFIKLSPPMLLKEPYKTAVIPINGSPRTPR

SEQ ID NO: 8697 - protein, 40 aa, Artificial Sequence
  Description of Artificial Sequence: Synthetic polypeptide
QLMLCVLDYFIKLSPPMLLKEPYKTAVIPINGSPRTPRRG

SEQ ID NO: 8698 - protein, 40 aa, Artificial Sequence
  Description of Artificial Sequence: Synthetic polypeptide
IKLSPPMLLKEPYKTAVIPINGSPRTPRRGQNRSARIAKQ

SEQ ID NO: 8699 - protein, 40 aa, Artificial Sequence
  Description of Artificial Sequence: Synthetic polypeptide
PINGSPRTPRRGQNRSARIAKQLENDTRIIEVLCKEHECN

SEQ ID NO: 8700 - protein, 40 aa, Artificial Sequence
  Description of Artificial Sequence: Synthetic polypeptide
NGSPRTPRRGQNRSARIAKQLENDTRIIEVLCKEHECNID

SEQ ID NO: 8701 - protein, 40 aa, Artificial Sequence
  Description of Artificial Sequence: Synthetic polypeptide
SPRTPRRGQNRSARIAKQLENDTRIIEVLCKEHECNIDEV

SEQ ID NO: 8702 - protein, 40 aa, Artificial Sequence
  Description of Artificial Sequence: Synthetic polypeptide
RGQNRSARIAKQLENDTRIIEVLCKEHECNIDEVKNVYFK

SEQ ID NO: 8703 - protein, 40 aa, Artificial Sequence
  Description of Artificial Sequence: Synthetic polypeptide
GQNRSARIAKQLENDTRIIEVLCKEHECNIDEVKNVYFKN

SEQ ID NO: 8704 - protein, 40 aa, Artificial Sequence
  Description of Artificial Sequence: Synthetic polypeptide
QNRSARIAKQLENDTRIIEVLCKEHECNIDEVKNVYFKNF

SEQ ID NO: 8705 - protein, 40 aa, Artificial Sequence
  Description of Artificial Sequence: Synthetic polypeptide
YFKNFIPFMNSLGLVTSNGLPEVENLSKRYEEIYLKNKDL

SEQ ID NO: 8706 - protein, 40 aa, Artificial Sequence
  Description of Artificial Sequence: Synthetic polypeptide
FKNFIPFMNSLGLVTSNGLPEVENLSKRYEEIYLKNKDLD

SEQ ID NO: 8707 - protein, 40 aa, Artificial Sequence
  Description of Artificial Sequence: Synthetic polypeptide
KNFIPFMNSLGLVTSNGLPEVENLSKRYEEIYLKNKDLDA

SEQ ID NO: 8708 - protein, 40 aa, Artificial Sequence
  Description of Artificial Sequence: Synthetic polypeptide
NFIPFMNSLGLVTSNGLPEVENLSKRYEEIYLKNKDLDAR

SEQ ID NO: 8709 - protein, 40 aa, Artificial Sequence
  Description of Artificial Sequence: Synthetic polypeptide
FIPFMNSLGLVTSNGLPEVENLSKRYEEIYLKNKDLDARL

SEQ ID NO: 8710 - protein, 40 aa, Artificial Sequence
  Description of Artificial Sequence: Synthetic polypeptide
IPFMNSLGLVTSNGLPEVENLSKRYEEIYLKNKDLDARLF

SEQ ID NO: 8711 - protein, 40 aa, Artificial Sequence
  Description of Artificial Sequence: Synthetic polypeptide
FMNSLGLVTSNGLPEVENLSKRYEEIYLKNKDLDARLFLD

SEQ ID NO: 8712 - protein, 40 aa, Artificial Sequence
  Description of Artificial Sequence: Synthetic polypeptide
NSLGLVTSNGLPEVENLSKRYEEIYLKNKDLDARLFLDHD

SEQ ID NO: 8713 - protein, 40 aa, Artificial Sequence
  Description of Artificial Sequence: Synthetic polypeptide
LGLVTSNGLPEVENLSKRYEEIYLKNKDLDARLFLDHDKT

SEQ ID NO: 8714 - protein, 40 aa, Artificial Sequence
  Description of Artificial Sequence: Synthetic polypeptide
LKNKDLDARLFLDHDKTLQTDSIDSFETQRTPRKSNLDEE

SEQ ID NO: 8715 - protein, 40 aa, Artificial Sequence
  Description of Artificial Sequence: Synthetic polypeptide
KNKDLDARLFLDHDKTLQTDSIDSFETQRTPRKSNLDEEV

SEQ ID NO: 8716 - protein, 40 aa, Artificial Sequence
  Description of Artificial Sequence: Synthetic polypeptide
KDLDARLFLDHDKTLQTDSIDSFETQRTPRKSNLDEEVNV

SEQ ID NO: 8717 - protein, 40 aa, Artificial Sequence
  Description of Artificial Sequence: Synthetic polypeptide
DARLFLDHDKTLQTDSIDSFETQRTPRKSNLDEEVNVIPP

SEQ ID NO: 8718 - protein, 40 aa, Artificial Sequence
  Description of Artificial Sequence: Synthetic polypeptide
TLQTDSIDSFETQRTPRKSNLDEEVNVIPPHTPVRTVMNT

SEQ ID NO: 8719 - protein, 40 aa, Artificial Sequence
  Description of Artificial Sequence: Synthetic polypeptide
LQTDSIDSFETQRTPRKSNLDEEVNVIPPHTPVRTVMNTI

SEQ ID NO: 8720 - protein, 40 aa, Artificial Sequence
  Description of Artificial Sequence: Synthetic polypeptide
FETQRTPRKSNLDEEVNVIPPHTPVRTVMNTIQQLMMILN

SEQ ID NO: 8721 - protein, 40 aa, Artificial Sequence
  Description of Artificial Sequence: Synthetic polypeptide
VRTVMNTIQQLMMILNSASDQPSENLISYFNNCTVNPKES

SEQ ID NO: 8722 - protein, 40 aa, Artificial Sequence
  Description of Artificial Sequence: Synthetic polypeptide
IQQLMMILNSASDQPSENLISYFNNCTVNPKESILKRVKD

SEQ ID NO: 8723 - protein, 40 aa, Artificial Sequence
  Description of Artificial Sequence: Synthetic polypeptide
QLMMILNSASDQPSENLISYFNNCTVNPKESILKRVKDIG

SEQ ID NO: 8724 - protein, 40 aa, Artificial Sequence
  Description of Artificial Sequence: Synthetic polypeptide
MMILNSASDQPSENLISYFNNCTVNPKESILKRVKDIGYI

SEQ ID NO: 8725 - protein, 40 aa, Artificial Sequence
  Description of Artificial Sequence: Synthetic polypeptide
ILNSASDQPSENLISYFNNCTVNPKESILKRVKDIGYIFK

SEQ ID NO: 8726 - protein, 40 aa, Artificial Sequence
  Description of Artificial Sequence: Synthetic polypeptide
LNSASDQPSENLISYFNNCTVNPKESILKRVKDIGYIFKE

SEQ ID NO: 8727 - protein, 40 aa, Artificial Sequence
  Description of Artificial Sequence: Synthetic polypeptide
ASDQPSENLISYFNNCTVNPKESILKRVKDIGYIFKEKFA

SEQ ID NO: 8728 - protein, 40 aa, Artificial Sequence
  Description of Artificial Sequence: Synthetic polypeptide
DQPSENLISYFNNCTVNPKESILKRVKDIGYIFKEKFAKA

SEQ ID NO: 8729 - protein, 40 aa, Artificial Sequence
  Description of Artificial Sequence: Synthetic polypeptide
QPSENLISYFNNCTVNPKESILKRVKDIGYIFKEKFAKAV

SEQ ID NO: 8730 - protein, 40 aa, Artificial Sequence
  Description of Artificial Sequence: Synthetic polypeptide
SENLISYFNNCTVNPKESILKRVKDIGYIFKEKFAKAVGQ

SEQ ID NO: 8731 - protein, 40 aa, Artificial Sequence
  Description of Artificial Sequence: Synthetic polypeptide
ENLISYFNNCTVNPKESILKRVKDIGYIFKEKFAKAVGQG

SEQ ID NO: 8732 - protein, 40 aa, Artificial Sequence
  Description of Artificial Sequence: Synthetic polypeptide
NLISYFNNCTVNPKESILKRVKDIGYIFKEKFAKAVGQGC

SEQ ID NO: 8733 - protein, 40 aa, Artificial Sequence
  Description of Artificial Sequence: Synthetic polypeptide
MISYFNNCTVNPKESILKRVKDIGYIFKEKFAKAVGQGCV

SEQ ID NO: 8734 - protein, 40 aa, Artificial Sequence
  Description of Artificial Sequence: Synthetic polypeptide
ISYFNNCTVNPKESILKRVKDIGYIFKEKFAKAVGQGCVE

SEQ ID NO: 8735 - protein, 40 aa, Artificial Sequence
  Description of Artificial Sequence: Synthetic polypeptide
SYFNNCTVNPKESILKRVKDIGYIFKEKFAKAVGQGCVEI

SEQ ID NO: 8736 - protein, 40 aa, Artificial Sequence
  Description of Artificial Sequence: Synthetic polypeptide
YFNNCTVNPKESILKRVKDIGYIFKEKFAKAVGQGCVEIG

SEQ ID NO: 8737 - protein, 40 aa, Artificial Sequence
  Description of Artificial Sequence: Synthetic polypeptide
CTVNPKESILKRVKDIGYIFKEKFAKAVGQGCVEIGSQRY

SEQ ID NO: 8738 - protein, 40 aa, Artificial Sequence
  Description of Artificial Sequence: Synthetic polypeptide
TVNPKESILKRVKDIGYIFKEKFAKAVGQGCVEIGSQRYK

SEQ ID NO: 8739 - protein, 40 aa, Artificial Sequence
  Description of Artificial Sequence: Synthetic polypeptide
ESILKRVKDIGYIFKEKFAKAVGQGCVEIGSQRYKLGVRL

SEQ ID NO: 8740 - protein, 40 aa, Artificial Sequence
  Description of Artificial Sequence: Synthetic polypeptide
MKRVKDIGYIFKEKFAKAVGQGCVEIGSQRYKLGVRLYYR

SEQ ID NO: 8741 - protein, 40 aa, Artificial Sequence
  Description of Artificial Sequence: Synthetic polypeptide
KRVKDIGYIFKEKFAKAVGQGCVEIGSQRYKLGVRLYYRV

SEQ ID NO: 8742 - protein, 40 aa, Artificial Sequence
  Description of Artificial Sequence: Synthetic polypeptide
RVKDIGYIFKEKFAKAVGQGCVEIGSQRYKLGVRLYYRVM

SEQ ID NO: 8743 - protein, 40 aa, Artificial Sequence
  Description of Artificial Sequence: Synthetic polypeptide
VKDIGYIFKEKFAKAVGQGCVEIGSQRYKLGVRLYYRVME

SEQ ID NO: 8744 - protein, 40 aa, Artificial Sequence
  Description of Artificial Sequence: Synthetic polypeptide
KDIGYIFKEKFAKAVGQGCVEIGSQRYKLGVRLYYRVMES

SEQ ID NO: 8745 - protein, 40 aa, Artificial Sequence
  Description of Artificial Sequence: Synthetic polypeptide
GYIFKEKFAKAVGQGCVEIGSQRYKLGVRLYYRVMESMLK

SEQ ID NO: 8746 - protein, 40 aa, Artificial Sequence
  Description of Artificial Sequence: Synthetic polypeptide
QGCVEIGSQRYKLGVRLYYRVMESMLKSEEERLSIQNFSK

SEQ ID NO: 8747 - protein, 40 aa, Artificial Sequence
  Description of Artificial Sequence: Synthetic polypeptide
CVEIGSQRYKLGVRLYYRVMESMLKSEEERLSIQNFSKLL

SEQ ID NO: 8748 - protein, 40 aa, Artificial Sequence
  Description of Artificial Sequence: Synthetic polypeptide
RVMESMLKSEEERLSIQNFSKLLNDNIFHMSLLACALEVV

SEQ ID NO: 8749 - protein, 40 aa, Artificial Sequence
  Description of Artificial Sequence: Synthetic polypeptide
SEEERLSIQNFSKLLNDNIFHMSLLACALEVVMATYSRST

SEQ ID NO: 8750 - protein, 40 aa, Artificial Sequence
  Description of Artificial Sequence: Synthetic polypeptide
RLSIQNFSKLLNDNIFHMSLLACALEVVMATYSRSTSQNL

SEQ ID NO: 8751 - protein, 40 aa, Artificial Sequence
  Description of Artificial Sequence: Synthetic polypeptide
LSIQNFSKLLNDNIFHMSLLACALEVVMATYSRSTSQNLD

SEQ ID NO: 8752 - protein, 40 aa, Artificial Sequence
  Description of Artificial Sequence: Synthetic polypeptide
SIQNFSKLLNDNIFHMSLLACALEVVMATYSRSTSQNLDS

SEQ ID NO: 8753 - protein, 40 aa, Artificial Sequence
  Description of Artificial Sequence: Synthetic polypeptide
NFSKLLNDNIFHMSLLACALEVVMATYSRSTSQNLDSGTD

SEQ ID NO: 8754 - protein, 40 aa, Artificial Sequence
  Description of Artificial Sequence: Synthetic polypeptide
SKLLNDNIFHMSLLACALEVVMATYSRSTSQNLDSGTDLS

SEQ ID NO: 8755 - protein, 40 aa, Artificial Sequence
  Description of Artificial Sequence: Synthetic polypeptide
KLLNDNIFHMSLLACALEVVMATYSRSTSQNLDSGTDLSF

SEQ ID NO: 8756 - protein, 40 aa, Artificial Sequence
  Description of Artificial Sequence: Synthetic polypeptide
LLNDNIFHMSLLACALEVVMATYSRSTSQNLDSGTDLSFP

SEQ ID NO: 8757 - protein, 40 aa, Artificial Sequence
  Description of Artificial Sequence: Synthetic polypeptide
NIFHMSLLACALEVVMATYSRSTSQNLDSGTDLSFPWILN

SEQ ID NO: 8758 - protein, 40 aa, Artificial Sequence
  Description of Artificial Sequence: Synthetic polypeptide
FHMSLLACALEVVMATYSRSTSQNLDSGTDLSFPWILNVL

SEQ ID NO: 8759 - protein, 40 aa, Artificial Sequence
  Description of Artificial Sequence: Synthetic polypeptide
HMSLLACALEVVMATYSRSTSQNLDSGTDLSFPWILNVLN

SEQ ID NO: 8760 - protein, 40 aa, Artificial Sequence
  Description of Artificial Sequence: Synthetic polypeptide
MACALEVVMATYSRSTSQNLDSGTDLSFPWILNVLNLKAF

SEQ ID NO: 8761 - protein, 40 aa, Artificial Sequence
  Description of Artificial Sequence: Synthetic polypeptide
ACALEVVMATYSRSTSQNLDSGTDLSFPWILNVLNLKAFD

SEQ ID NO: 8762 - protein, 40 aa, Artificial Sequence
  Description of Artificial Sequence: Synthetic polypeptide
ALEVVMATYSRSTSQNLDSGTDLSFPWILNVLNLKAFDFY

SEQ ID NO: 8763 - protein, 40 aa, Artificial Sequence
  Description of Artificial Sequence: Synthetic polypeptide
EVVMATYSRSTSQNLDSGTDLSFPWILNVLNLKAFDFYKV

SEQ ID NO: 8764 - protein, 40 aa, Artificial Sequence
  Description of Artificial Sequence: Synthetic polypeptide
VVMATYSRSTSQNLDSGTDLSFPWILNVLNLKAFDFYKVI

SEQ ID NO: 8765 - protein, 40 aa, Artificial Sequence
  Description of Artificial Sequence: Synthetic polypeptide
VMATYSRSTSQNLDSGTDLSFPWILNVLNLKAFDFYKVIE

SEQ ID NO: 8766 - protein, 40 aa, Artificial Sequence
  Description of Artificial Sequence: Synthetic polypeptide
MATYSRSTSQNLDSGTDLSFPWILNVLNLKAFDFYKVIES

SEQ ID NO: 8767 - protein, 40 aa, Artificial Sequence
  Description of Artificial Sequence: Synthetic polypeptide
TYSRSTSQNLDSGTDLSFPWILNVLNLKAFDFYKVIESFI

SEQ ID NO: 8768 - protein, 40 aa, Artificial Sequence
  Description of Artificial Sequence: Synthetic polypeptide
YSRSTSQNLDSGTDLSFPWILNVLNLKAFDFYKVIESFIK

SEQ ID NO: 8769 - protein, 40 aa, Artificial Sequence
  Description of Artificial Sequence: Synthetic polypeptide
SRSTSQNLDSGTDLSFPWILNVLNLKAFDFYKVIESFIKA

SEQ ID NO: 8770 - protein, 40 aa, Artificial Sequence
  Description of Artificial Sequence: Synthetic polypeptide
SQNLDSGTDLSFPWILNVLNLKAFDFYKVIESFIKAEGNL

SEQ ID NO: 8771 - protein, 40 aa, Artificial Sequence
  Description of Artificial Sequence: Synthetic polypeptide
QNLDSGTDLSFPWILNVLNLKAFDFYKVIESFIKAEGNLT

SEQ ID NO: 8772 - protein, 40 aa, Artificial Sequence
  Description of Artificial Sequence: Synthetic polypeptide
LDSGTDLSFPWILNVLNLKAFDFYKVIESFIKAEGNLTRE

SEQ ID NO: 8773 - protein, 40 aa, Artificial Sequence
  Description of Artificial Sequence: Synthetic polypeptide
DSGTDLSFPWILNVLNLKAFDFYKVIESFIKAEGNLTREM

SEQ ID NO: 8774 - protein, 40 aa, Artificial Sequence
  Description of Artificial Sequence: Synthetic polypeptide
SGTDLSFPWILNVLNLKAFDFYKVIESFIKAEGNLTREMI

SEQ ID NO: 8775 - protein, 40 aa, Artificial Sequence
  Description of Artificial Sequence: Synthetic polypeptide
GTDLSFPWILNVLNLKAFDFYKVIESFIKAEGNLTREMIK

SEQ ID NO: 8776 - protein, 40 aa, Artificial Sequence
  Description of Artificial Sequence: Synthetic polypeptide
LKAFDFYKVIESFIKAEGNLTREMIKHLERCEHRIMESLA

SEQ ID NO: 8777 - protein, 40 aa, Artificial Sequence
  Description of Artificial Sequence: Synthetic polypeptide
KAFDFYKVIESFIKAEGNLTREMIKHLERCEHRIMESLAW

SEQ ID NO: 8778 - protein, 40 aa, Artificial Sequence
  Description of Artificial Sequence: Synthetic polypeptide
NLTREMIKHLERCEHRIMESLAWLSDSPLFDLIKQSKDRE

SEQ ID NO: 8779 - protein, 40 aa, Artificial Sequence
  Description of Artificial Sequence: Synthetic polypeptide
ESLAWLSDSPLFDLIKQSKDREGPTDHLESACPLNLPLQN

SEQ ID NO: 8780 - protein, 40 aa, Artificial Sequence
  Description of Artificial Sequence: Synthetic polypeptide
LAWLSDSPLFDLIKQSKDREGPTDHLESACPLNLPLQNNH

SEQ ID NO: 8781 - protein, 40 aa, Artificial Sequence
  Description of Artificial Sequence: Synthetic polypeptide
HLESACPLNLPLQNNHTAADMYLSPVRSPKKKGSTTRVNS

SEQ ID NO: 8782 - protein, 40 aa, Artificial Sequence
  Description of Artificial Sequence: Synthetic polypeptide
LESACPLNLPLQNNHTAADMYLSPVRSPKKKGSTTRVNST

SEQ ID NO: 8783 - protein, 40 aa, Artificial Sequence
  Description of Artificial Sequence: Synthetic polypeptide
ESACPLNLPLQNNHTAADMYLSPVRSPKKKGSTTRVNSTA

SEQ ID NO: 8784 - protein, 40 aa, Artificial Sequence
  Description of Artificial Sequence: Synthetic polypeptide
SACPLNLPLQNNHTAADMYLSPVRSPKKKGSTTRVNSTAN

SEQ ID NO: 8785 - protein, 40 aa, Artificial Sequence
  Description of Artificial Sequence: Synthetic polypeptide
AADMYLSPVRSPKKKGSTTRVNSTANAETQATSAFQTQKP

SEQ ID NO: 8786 - protein, 40 aa, Artificial Sequence
  Description of Artificial Sequence: Synthetic polypeptide
DMYLSPVRSPKKKGSTTRVNSTANAETQATSAFQTQKPLK

SEQ ID NO: 8787 - protein, 40 aa, Artificial Sequence
  Description of Artificial Sequence: Synthetic polypeptide
MYLSPVRSPKKKGSTTRVNSTANAETQATSAFQTQKPLKS

SEQ ID NO: 8788 - protein, 40 aa, Artificial Sequence
  Description of Artificial Sequence: Synthetic polypeptide
SPVRSPKKKGSTTRVNSTANAETQATSAFQTQKPLKSTSL

SEQ ID NO: 8789 - protein, 40 aa, Artificial Sequence
  Description of Artificial Sequence: Synthetic polypeptide
VRSPKKKGSTTRVNSTANAETQATSAFQTQKPLKSTSLSL

SEQ ID NO: 8790 - protein, 40 aa, Artificial Sequence
  Description of Artificial Sequence: Synthetic polypeptide
RSPKKKGSTTRVNSTANAETQATSAFQTQKPLKSTSLSLF

SEQ ID NO: 8791 - protein, 40 aa, Artificial Sequence
  Description of Artificial Sequence: Synthetic polypeptide
PKKKGSTTRVNSTANAETQATSAFQTQKPLKSTSLSLFYK

SEQ ID NO: 8792 - protein, 40 aa, Artificial Sequence
  Description of Artificial Sequence: Synthetic polypeptide
KKKGSTTRVNSTANAETQATSAFQTQKPLKSTSLSLFYKK

SEQ ID NO: 8793 - protein, 40 aa, Artificial Sequence
  Description of Artificial Sequence: Synthetic polypeptide
KKGSTTRVNSTANAETQATSAFQTQKPLKSTSLSLFYKKV

SEQ ID NO: 8794 - protein, 40 aa, Artificial Sequence
  Description of Artificial Sequence: Synthetic polypeptide
STTRVNSTANAETQATSAFQTQKPLKSTSLSLFYKKVYRL

SEQ ID NO: 8795 - protein, 40 aa, Artificial Sequence
  Description of Artificial Sequence: Synthetic polypeptide
TTRVNSTANAETQATSAFQTQKPLKSTSLSLFYKKVYRLA

SEQ ID NO: 8796 - protein, 40 aa, Artificial Sequence
  Description of Artificial Sequence: Synthetic polypeptide
TRVNSTANAETQATSAFQTQKPLKSTSLSLFYKKVYRLAY

SEQ ID NO: 8797 - protein, 40 aa, Artificial Sequence
  Description of Artificial Sequence: Synthetic polypeptide
RVNSTANAETQATSAFQTQKPLKSTSLSLFYKKVYRLAYL

SEQ ID NO: 8798 - protein, 40 aa, Artificial Sequence
  Description of Artificial Sequence: Synthetic polypeptide
VNSTANAETQATSAFQTQKPLKSTSLSLFYKKVYRLAYLR

SEQ ID NO: 8799 - protein, 40 aa, Artificial Sequence
  Description of Artificial Sequence: Synthetic polypeptide
TQATSAFQTQKPLKSTSLSLFYKKVYRLAYLRLNTLCERL

SEQ ID NO: 8800 - protein, 40 aa, Artificial Sequence
  Description of Artificial Sequence: Synthetic polypeptide
AFQTQKPLKSTSLSLFYKKVYRLAYLRLNTLCERLLSEHP

SEQ ID NO: 8801 - protein, 40 aa, Artificial Sequence
  Description of Artificial Sequence: Synthetic polypeptide
TQKPLKSTSLSLFYKKVYRLAYLRLNTLCERLLSEHPELE

SEQ ID NO: 8802 - protein, 40 aa, Artificial Sequence
  Description of Artificial Sequence: Synthetic polypeptide
MKSTSLSLFYKKVYRLAYLRLNTLCERLLSEHPELEHIIW

SEQ ID NO: 8803 - protein, 40 aa, Artificial Sequence
  Description of Artificial Sequence: Synthetic polypeptide
KSTSLSLFYKKVYRLAYLRLNTLCERLLSEHPELEHIIWT

SEQ ID NO: 8804 - protein, 40 aa, Artificial Sequence
  Description of Artificial Sequence: Synthetic polypeptide
STSLSLFYKKVYRLAYLRLNTLCERLLSEHPELEHIIWTL

SEQ ID NO: 8805 - protein, 40 aa, Artificial Sequence
  Description of Artificial Sequence: Synthetic polypeptide
NTLCERLLSEHPELEHIIWTLFQHTLQNEYELMRDRHLDQ

SEQ ID NO: 8806 - protein, 40 aa, Artificial Sequence
  Description of Artificial Sequence: Synthetic polypeptide
QHTLQNEYELMRDRHLDQIMMCSMYGICKVKNIDLKFKII

SEQ ID NO: 8807 - protein, 40 aa, Artificial Sequence
  Description of Artificial Sequence: Synthetic polypeptide
YELMRDRHLDQIMMCSMYGICKVKNIDLKFKIIVTAYKDL

SEQ ID NO: 8808 - protein, 40 aa, Artificial Sequence
  Description of Artificial Sequence: Synthetic polypeptide
TAYKDLPHAVQETFKRVLIKEEEYDSIIVFYNSVFMQRLK

SEQ ID NO: 8809 - protein, 40 aa, Artificial Sequence
  Description of Artificial Sequence: Synthetic polypeptide
AYKDLPHAVQETFKRVLIKEEEYDSIIVFYNSVFMQRLKT

SEQ ID NO: 8810 - protein, 40 aa, Artificial Sequence
  Description of Artificial Sequence: Synthetic polypeptide
QETFKRVLIKEEEYDSIIVFYNSVFMQRLKTNILQYASTR

SEQ ID NO: 8811 - protein, 40 aa, Artificial Sequence
  Description of Artificial Sequence: Synthetic polypeptide
TFKRVLIKEEEYDSIIVFYNSVFMQRLKTNILQYASTRPP

SEQ ID NO: 8812 - protein, 40 aa, Artificial Sequence
  Description of Artificial Sequence: Synthetic polypeptide
YDSIIVFYNSVFMQRLKTNILQYASTRPPTLSPIPHIPRS

SEQ ID NO: 8813 - protein, 40 aa, Artificial Sequence
  Description of Artificial Sequence: Synthetic polypeptide
DSIIVFYNSVFMQRLKTNILQYASTRPPTLSPIPHIPRSP

SEQ ID NO: 8814 - protein, 40 aa, Artificial Sequence
  Description of Artificial Sequence: Synthetic polypeptide
VFYNSVFMQRLKTNILQYASTRPPTLSPIPHIPRSPYKFP

SEQ ID NO: 8815 - protein, 40 aa, Artificial Sequence
  Description of Artificial Sequence: Synthetic polypeptide
NILQYASTRPPTLSPIPHIPRSPYKFPSSPLRIPGGNIYI

SEQ ID NO: 8816 - protein, 40 aa, Artificial Sequence
  Description of Artificial Sequence: Synthetic polypeptide
ILQYASTRPPTLSPIPHIPRSPYKFPSSPLRIPGGNIYIS

SEQ ID NO: 8817 - protein, 40 aa, Artificial Sequence
  Description of Artificial Sequence: Synthetic polypeptide
QYASTRPPTLSPIPHIPRSPYKFPSSPLRIPGGNIYISPL

SEQ ID NO: 8818 - protein, 40 aa, Artificial Sequence
  Description of Artificial Sequence: Synthetic polypeptide
STRPPTLSPIPHIPRSPYKFPSSPLRIPGGNIYISPLKSP

SEQ ID NO: 8819 - protein, 40 aa, Artificial Sequence
  Description of Artificial Sequence: Synthetic polypeptide
RPPTLSPIPHIPRSPYKFPSSPLRIPGGNIYISPLKSPYK

SEQ ID NO: 8820 - protein, 40 aa, Artificial Sequence
  Description of Artificial Sequence: Synthetic polypeptide
PPTLSPIPHIPRSPYKFPSSPLRIPGGNIYISPLKSPYKI

SEQ ID NO: 8821 - protein, 40 aa, Artificial Sequence
  Description of Artificial Sequence: Synthetic polypeptide
PTLSPIPHIPRSPYKFPSSPLRIPGGNIYISPLKSPYKIS

SEQ ID NO: 8822 - protein, 40 aa, Artificial Sequence
  Description of Artificial Sequence: Synthetic polypeptide
TLSPIPHIPRSPYKFPSSPLRIPGGNIYISPLKSPYKISE

SEQ ID NO: 8823 - protein, 40 aa, Artificial Sequence
  Description of Artificial Sequence: Synthetic polypeptide
SPIPHIPRSPYKFPSSPLRIPGGNIYISPLKSPYKISEGL

SEQ ID NO: 8824 - protein, 40 aa, Artificial Sequence
  Description of Artificial Sequence: Synthetic polypeptide
PIPHIPRSPYKFPSSPLRIPGGNIYISPLKSPYKISEGLP

SEQ ID NO: 8825 - protein, 40 aa, Artificial Sequence
  Description of Artificial Sequence: Synthetic polypeptide
IPHIPRSPYKFPSSPLRIPGGNIYISPLKSPYKISEGLPT

SEQ ID NO: 8826 - protein, 40 aa, Artificial Sequence
  Description of Artificial Sequence: Synthetic polypeptide
PRSPYKFPSSPLRIPGGNIYISPLKSPYKISEGLPTPTKM

SEQ ID NO: 8827 - protein, 40 aa, Artificial Sequence
  Description of Artificial Sequence: Synthetic polypeptide
FPSSPLRIPGGNIYISPLKSPYKISEGLPTPTKMTPRSRI

SEQ ID NO: 8828 - protein, 40 aa, Artificial Sequence
  Description of Artificial Sequence: Synthetic polypeptide
PSSPLRIPGGNIYISPLKSPYKISEGLPTPTKMTPRSRIL

SEQ ID NO: 8829 - protein, 40 aa, Artificial Sequence
  Description of Artificial Sequence: Synthetic polypeptide
LRIPGGNIYISPLKSPYKISEGLPTPTKMTPRSRILVSIG

SEQ ID NO: 8830 - protein, 40 aa, Artificial Sequence
  Description of Artificial Sequence: Synthetic polypeptide
PLKSPYKISEGLPTPTKMTPRSRILVSIGESFGTSEKFQK

SEQ ID NO: 8831 - protein, 40 aa, Artificial Sequence
  Description of Artificial Sequence: Synthetic polypeptide
MKSPYKISEGLPTPTKMTPRSRILVSIGESFGTSEKFQKI

SEQ ID NO: 8832 - protein, 40 aa, Artificial Sequence
  Description of Artificial Sequence: Synthetic polypeptide
KSPYKISEGLPTPTKMTPRSRILVSIGESFGTSEKFQKIN

SEQ ID NO: 8833 - protein, 40 aa, Artificial Sequence
  Description of Artificial Sequence: Synthetic polypeptide
SPYKISEGLPTPTKMTPRSRILVSIGESFGTSEKFQKINQ

SEQ ID NO: 8834 - protein, 40 aa, Artificial Sequence
  Description of Artificial Sequence: Synthetic polypeptide
PYKISEGLPTPTKMTPRSRILVSIGESFGTSEKFQKINQM

SEQ ID NO: 8835 - protein, 40 aa, Artificial Sequence
  Description of Artificial Sequence: Synthetic polypeptide
ISEGLPTPTKMTPRSRILVSIGESFGTSEKFQKINQMVCN

SEQ ID NO: 8836 - protein, 40 aa, Artificial Sequence
  Description of Artificial Sequence: Synthetic polypeptide
SEGLPTPTKMTPRSRILVSIGESFGTSEKFQKINQMVCNS

SEQ ID NO: 8837 - protein, 40 aa, Artificial Sequence
  Description of Artificial Sequence: Synthetic polypeptide
EGLPTPTKMTPRSRILVSIGESFGTSEKFQKINQMVCNSD

SEQ ID NO: 8838 - protein, 40 aa, Artificial Sequence
  Description of Artificial Sequence: Synthetic polypeptide
MPTPTKMTPRSRILVSIGESFGTSEKFQKINQMVCNSDRV

SEQ ID NO: 8839 - protein, 40 aa, Artificial Sequence
  Description of Artificial Sequence: Synthetic polypeptide
KMTPRSRILVSIGESFGTSEKFQKINQMVCNSDRVLKRSA

SEQ ID NO: 8840 - protein, 40 aa, Artificial Sequence
  Description of Artificial Sequence: Synthetic polypeptide
RSRILVSIGESFGTSEKFQKINQMVCNSDRVLKRSAEGSN

SEQ ID NO: 8841 - protein, 40 aa, Artificial Sequence
  Description of Artificial Sequence: Synthetic polypeptide
ILVSIGESFGTSEKFQKINQMVCNSDRVLKRSAEGSNPPK

SEQ ID NO: 8842 - protein, 40 aa, Artificial Sequence
  Description of Artificial Sequence: Synthetic polypeptide
ESFGTSEKFQKINQMVCNSDRVLKRSAEGSNPPKPLKKLR

SEQ ID NO: 8843 - protein, 40 aa, Artificial Sequence
  Description of Artificial Sequence: Synthetic polypeptide
SFGTSEKFQKINQMVCNSDRVLKRSAEGSNPPKPLKKLRF

SEQ ID NO: 8844 - protein, 40 aa, Artificial Sequence
  Description of Artificial Sequence: Synthetic polypeptide
FGTSEKFQKINQMVCNSDRVLKRSAEGSNPPKPLKKLRFD

SEQ ID NO: 8845 - protein, 40 aa, Artificial Sequence
  Description of Artificial Sequence: Synthetic polypeptide
GTSEKFQKINQMVCNSDRVLKRSAEGSNPPKPLKKLRFDI

SEQ ID NO: 8846 - protein, 40 aa, Artificial Sequence
  Description of Artificial Sequence: Synthetic polypeptide
TSEKFQKINQMVCNSDRVLKRSAEGSNPPKPLKKLRFDIE

SEQ ID NO: 8847 - protein, 40 aa, Artificial Sequence
  Description of Artificial Sequence: Synthetic polypeptide
EKFQKINQMVCNSDRVLKRSAEGSNPPKPLKKLRFDIEGS

SEQ ID NO: 8848 - protein, 40 aa, Artificial Sequence
  Description of Artificial Sequence: Synthetic polypeptide
KFQKINQMVCNSDRVLKRSAEGSNPPKPLKKLRFDIEGSD

SEQ ID NO: 8849 - protein, 40 aa, Artificial Sequence
  Description of Artificial Sequence: Synthetic polypeptide
FQKINQMVCNSDRVLKRSAEGSNPPKPLKKLRFDIEGSDE

SEQ ID NO: 8850 - protein, 40 aa, Artificial Sequence
  Description of Artificial Sequence: Synthetic polypeptide
QKINQMVCNSDRVLKRSAEGSNPPKPLKKLRFDIEGSDEA

SEQ ID NO: 8851 - protein, 40 aa, Artificial Sequence
  Description of Artificial Sequence: Synthetic polypeptide
KINQMVCNSDRVLKRSAEGSNPPKPLKKLRFDIEGSDEAD

SEQ ID NO: 8852 - protein, 40 aa, Artificial Sequence
  Description of Artificial Sequence: Synthetic polypeptide
NQMVCNSDRVLKRSAEGSNPPKPLKKLRFDIEGSDEADGS

SEQ ID NO: 8853 - protein, 40 aa, Artificial Sequence
  Description of Artificial Sequence: Synthetic polypeptide
VCNSDRVLKRSAEGSNPPKPLKKLRFDIEGSDEADGSKHL

SEQ ID NO: 8854 - protein, 40 aa, Artificial Sequence
  Description of Artificial Sequence: Synthetic polypeptide
SDRVLKRSAEGSNPPKPLKKLRFDIEGSDEADGSKHLPGE

SEQ ID NO: 8855 - protein, 40 aa, Artificial Sequence
  Description of Artificial Sequence: Synthetic polypeptide
KRSAEGSNPPKPLKKLRFDIEGSDEADGSKHLPGESKFQQ

SEQ ID NO: 8856 - protein, 40 aa, Artificial Sequence
  Description of Artificial Sequence: Synthetic polypeptide
AEGSNPPKPLKKLRFDIEGSDEADGSKHLPGESKFQQKLA

SEQ ID NO: 8857 - protein, 40 aa, Artificial Sequence
  Description of Artificial Sequence: Synthetic polypeptide
GSNPPKPLKKLRFDIEGSDEADGSKHLPGESKFQQKLAEM

SEQ ID NO: 8858 - protein, 40 aa, Artificial Sequence
  Description of Artificial Sequence: Synthetic polypeptide
SNPPKPLKKLRFDIEGSDEADGSKHLPGESKFQQKLAEMT

SEQ ID NO: 8859 - protein, 40 aa, Artificial Sequence
  Description of Artificial Sequence: Synthetic polypeptide
NPPKPLKKLRFDIEGSDEADGSKHLPGESKFQQKLAEMTS

SEQ ID NO: 8860 - protein, 40 aa, Artificial Sequence
  Description of Artificial Sequence: Synthetic polypeptide
KPLKKLRFDIEGSDEADGSKHLPGESKFQQKLAEMTSTRT

SEQ ID NO: 8861 - protein, 40 aa, Artificial Sequence
  Description of Artificial Sequence: Synthetic polypeptide
DGSKHLPGESKFQQKLAEMTSTRTRMQKQKMNDSMDTSNK

SEQ ID NO: 8862 - protein, 40 aa, Artificial Sequence
  Description of Artificial Sequence: Synthetic polypeptide
MTIQFVEGQFVDSYDPTIENTFTKLITVNGQEYHLQLVDT

SEQ ID NO: 8863 - protein, 40 aa, Artificial Sequence
  Description of Artificial Sequence: Synthetic polypeptide
ITVNGQEYHLQLVDTAGQDEYSIFPQTYSIDINGYILVYS

SEQ ID NO: 8864 - protein, 40 aa, Artificial Sequence
  Description of Artificial Sequence: Synthetic polypeptide
YHLQLVDTAGQDEYSIFPQTYSIDINGYILVYSVTSIKSF

SEQ ID NO: 8865 - protein, 40 aa, Artificial Sequence
  Description of Artificial Sequence: Synthetic polypeptide
VDTAGQDEYSIFPQTYSIDINGYILVYSVTSIKSFEVIKV

SEQ ID NO: 8866 - protein, 40 aa, Artificial Sequence
  Description of Artificial Sequence: Synthetic polypeptide
DTAGQDEYSIFPQTYSIDINGYILVYSVTSIKSFEVIKVI

SEQ ID NO: 8867 - protein, 40 aa, Artificial Sequence
  Description of Artificial Sequence: Synthetic polypeptide
AGQDEYSIFPQTYSIDINGYILVYSVTSIKSFEVIKVIHG

SEQ ID NO: 8868 - protein, 40 aa, Artificial Sequence
  Description of Artificial Sequence: Synthetic polypeptide
GQDEYSIFPQTYSIDINGYILVYSVTSIKSFEVIKVIHGK

SEQ ID NO: 8869 - protein, 40 aa, Artificial Sequence
  Description of Artificial Sequence: Synthetic polypeptide
EYSIFPQTYSIDINGYILVYSVTSIKSFEVIKVIHGKLLD

SEQ ID NO: 8870 - protein, 40 aa, Artificial Sequence
  Description of Artificial Sequence: Synthetic polypeptide
SIFPQTYSIDINGYILVYSVTSIKSFEVIKVIHGKLLDMV

SEQ ID NO: 8871 - protein, 40 aa, Artificial Sequence
  Description of Artificial Sequence: Synthetic polypeptide
FPQTYSIDINGYILVYSVTSIKSFEVIKVIHGKLLDMVGK

SEQ ID NO: 8872 - protein, 40 aa, Artificial Sequence
  Description of Artificial Sequence: Synthetic polypeptide
QTYSIDINGYILVYSVTSIKSFEVIKVIHGKLLDMVGKVQ

SEQ ID NO: 8873 - protein, 40 aa, Artificial Sequence
  Description of Artificial Sequence: Synthetic polypeptide
TYSIDINGYILVYSVTSIKSFEVIKVIHGKLLDMVGKVQI

SEQ ID NO: 8874 - protein, 40 aa, Artificial Sequence
  Description of Artificial Sequence: Synthetic polypeptide
YSIDINGYILVYSVTSIKSFEVIKVIHGKLLDMVGKVQIP

SEQ ID NO: 8875 - protein, 40 aa, Artificial Sequence
  Description of Artificial Sequence: Synthetic polypeptide
SIDINGYILVYSVTSIKSFEVIKVIHGKLLDMVGKVQIPI

SEQ ID NO: 8876 - protein, 40 aa, Artificial Sequence
  Description of Artificial Sequence: Synthetic polypeptide
IDINGYILVYSVTSIKSFEVIKVIHGKLLDMVGKVQIPIM

SEQ ID NO: 8877 - protein, 40 aa, Artificial Sequence
  Description of Artificial Sequence: Synthetic polypeptide
DINGYILVYSVTSIKSFEVIKVIHGKLLDMVGKVQIPIML

SEQ ID NO: 8878 - protein, 40 aa, Artificial Sequence
  Description of Artificial Sequence: Synthetic polypeptide
INGYILVYSVTSIKSFEVIKVIHGKLLDMVGKVQIPIMLV

SEQ ID NO: 8879 - protein, 40 aa, Artificial Sequence
  Description of Artificial Sequence: Synthetic polypeptide
NGYILVYSVTSIKSFEVIKVIHGKLLDMVGKVQIPIMLVG

SEQ ID NO: 8880 - protein, 40 aa, Artificial Sequence
  Description of Artificial Sequence: Synthetic polypeptide
GYILVYSVTSIKSFEVIKVIHGKLLDMVGKVQIPIMLVGN

SEQ ID NO: 8881 - protein, 40 aa, Artificial Sequence
  Description of Artificial Sequence: Synthetic polypeptide
YILVYSVTSIKSFEVIKVIHGKLLDMVGKVQIPIMLVGNK

SEQ ID NO: 8882 - protein, 40 aa, Artificial Sequence
  Description of Artificial Sequence: Synthetic polypeptide
YSVTSIKSFEVIKVIHGKLLDMVGKVQIPIMLVGNKKDLH

SEQ ID NO: 8883 - protein, 40 aa, Artificial Sequence
  Description of Artificial Sequence: Synthetic polypeptide
SIKSFEVIKVIHGKLLDMVGKVQIPIMLVGNKKDLHMERV

SEQ ID NO: 8884 - protein, 40 aa, Artificial Sequence
  Description of Artificial Sequence: Synthetic polypeptide
IKSFEVIKVIHGKLLDMVGKVQIPIMLVGNKKDLHMERVI

SEQ ID NO: 8885 - protein, 40 aa, Artificial Sequence
  Description of Artificial Sequence: Synthetic polypeptide
SFEVIKVIHGKLLDMVGKVQIPIMLVGNKKDLHMERVISY

SEQ ID NO: 8886 - protein, 40 aa, Artificial Sequence
  Description of Artificial Sequence: Synthetic polypeptide
IKVIHGKLLDMVGKVQIPIMLVGNKKDLHMERVISYEEGK

SEQ ID NO: 8887 - protein, 40 aa, Artificial Sequence
  Description of Artificial Sequence: Synthetic polypeptide
KLLDMVGKVQIPIMLVGNKKDLHMERVISYEEGKALAESW

SEQ ID NO: 8888 - protein, 40 aa, Artificial Sequence
  Description of Artificial Sequence: Synthetic polypeptide
MLDMVGKVQIPIMLVGNKKDLHMERVISYEEGKALAESWN

SEQ ID NO: 8889 - protein, 40 aa, Artificial Sequence
  Description of Artificial Sequence: Synthetic polypeptide
MVGKVQIPIMLVGNKKDLHMERVISYEEGKALAESWNAAF

SEQ ID NO: 8890 - protein, 40 aa, Artificial Sequence
  Description of Artificial Sequence: Synthetic polypeptide
VGKVQIPIMLVGNKKDLHMERVISYEEGKALAESWNAAFL

SEQ ID NO: 8891 - protein, 40 aa, Artificial Sequence
  Description of Artificial Sequence: Synthetic polypeptide
IMLVGNKKDLHMERVISYEEGKALAESWNAAFLESSAKEN

SEQ ID NO: 8892 - protein, 40 aa, Artificial Sequence
  Description of Artificial Sequence: Synthetic polypeptide
MVGNKKDLHMERVISYEEGKALAESWNAAFLESSAKENQT

SEQ ID NO: 8893 - protein, 40 aa, Artificial Sequence
  Description of Artificial Sequence: Synthetic polypeptide
KKDLHMERVISYEEGKALAESWNAAFLESSAKENQTAVDV

SEQ ID NO: 8894 - protein, 40 aa, Artificial Sequence
  Description of Artificial Sequence: Synthetic polypeptide
KDLHMERVISYEEGKALAESWNAAFLESSAKENQTAVDVF

SEQ ID NO: 8895 - protein, 40 aa, Artificial Sequence
  Description of Artificial Sequence: Synthetic polypeptide
DLHMERVISYEEGKALAESWNAAFLESSAKENQTAVDVFR

SEQ ID NO: 8896 - protein, 40 aa, Artificial Sequence
  Description of Artificial Sequence: Synthetic polypeptide
ERVISYEEGKALAESWNAAFLESSAKENQTAVDVFRRIIL

SEQ ID NO: 8897 - protein, 40 aa, Artificial Sequence
  Description of Artificial Sequence: Synthetic polypeptide
ISYEEGKALAESWNAAFLESSAKENQTAVDVFRRIILEAE

SEQ ID NO: 8898 - protein, 40 aa, Artificial Sequence
  Description of Artificial Sequence: Synthetic polypeptide
YEEGKALAESWNAAFLESSAKENQTAVDVFRRIILEAEKM

SEQ ID NO: 8899 - protein, 40 aa, Artificial Sequence
  Description of Artificial Sequence: Synthetic polypeptide
ESWNAAFLESSAKENQTAVDVFRRIILEAEKMDGAASQGK

SEQ ID NO: 8900 - protein, 40 aa, Artificial Sequence
  Description of Artificial Sequence: Synthetic polypeptide
NAAFLESSAKENQTAVDVFRRIILEAEKMDGAASQGKSSC

SEQ ID NO: 8901 - protein, 40 aa, Artificial Sequence
  Description of Artificial Sequence: Synthetic polypeptide
AFLESSAKENQTAVDVFRRIILEAEKMDGAASQGKSSCSV

SEQ ID NO: 8902 - protein, 40 aa, Artificial Sequence
  Description of Artificial Sequence: Synthetic polypeptide
MAAIRKKLVIVGDGACGKTCLLIVFSKDQFPEVYVPTVFE

SEQ ID NO: 8903 - protein, 40 aa, Artificial Sequence
  Description of Artificial Sequence: Synthetic polypeptide
GDGACGKTCLLIVFSKDQFPEVYVPTVFENYVADIEVDGK

SEQ ID NO: 8904 - protein, 40 aa, Artificial Sequence
  Description of Artificial Sequence: Synthetic polypeptide
KTCLLIVFSKDQFPEVYVPTVFENYVADIEVDGKQVELAL

SEQ ID NO: 8905 - protein, 40 aa, Artificial Sequence
  Description of Artificial Sequence: Synthetic polypeptide
FSKDQFPEVYVPTVFENYVADIEVDGKQVELALWDTAGQE

SEQ ID NO: 8906 - protein, 40 aa, Artificial Sequence
  Description of Artificial Sequence: Synthetic polypeptide
DQFPEVYVPTVFENYVADIEVDGKQVELALWDTAGQEDYD

SEQ ID NO: 8907 - protein, 40 aa, Artificial Sequence
  Description of Artificial Sequence: Synthetic polypeptide
FPEVYVPTVFENYVADIEVDGKQVELALWDTAGQEDYDRL

SEQ ID NO: 8908 - protein, 40 aa, Artificial Sequence
  Description of Artificial Sequence: Synthetic polypeptide
PEVYVPTVFENYVADIEVDGKQVELALWDTAGQEDYDRLR

SEQ ID NO: 8909 - protein, 40 aa, Artificial Sequence
  Description of Artificial Sequence: Synthetic polypeptide
DRLRPLSYPDTDVILMCFSIDSPDSLENIPEKWTPEVKHF

SEQ ID NO: 8910 - protein, 40 aa, Artificial Sequence
  Description of Artificial Sequence: Synthetic polypeptide
RLRPLSYPDTDVILMCFSIDSPDSLENIPEKWTPEVKHFC

SEQ ID NO: 8911 - protein, 40 aa, Artificial Sequence
  Description of Artificial Sequence: Synthetic polypeptide
MRPLSYPDTDVILMCFSIDSPDSLENIPEKWTPEVKHFCP

SEQ ID NO: 8912 - protein, 40 aa, Artificial Sequence
  Description of Artificial Sequence: Synthetic polypeptide
PDSLENIPEKWTPEVKHFCPNVPIILVGNKKDLRNDEHTR

SEQ ID NO: 8913 - protein, 40 aa, Artificial Sequence
  Description of Artificial Sequence: Synthetic polypeptide
DSLENIPEKWTPEVKHFCPNVPIILVGNKKDLRNDEHTRR

SEQ ID NO: 8914 - protein, 40 aa, Artificial Sequence
  Description of Artificial Sequence: Synthetic polypeptide
SLENIPEKWTPEVKHFCPNVPIILVGNKKDLRNDEHTRRE

SEQ ID NO: 8915 - protein, 40 aa, Artificial Sequence
  Description of Artificial Sequence: Synthetic polypeptide
VGNKKDLRNDEHTRRELAKMKQEPVKPEEGRDMANRIGAF

SEQ ID NO: 8916 - protein, 40 aa, Artificial Sequence
  Description of Artificial Sequence: Synthetic polypeptide
GNKKDLRNDEHTRRELAKMKQEPVKPEEGRDMANRIGAFG

SEQ ID NO: 8917 - protein, 40 aa, Artificial Sequence
  Description of Artificial Sequence: Synthetic polypeptide
TRRELAKMKQEPVKPEEGRDMANRIGAFGYMECSAKTKDG

SEQ ID NO: 8918 - protein, 40 aa, Artificial Sequence
  Description of Artificial Sequence: Synthetic polypeptide
RRELAKMKQEPVKPEEGRDMANRIGAFGYMECSAKTKDGV

SEQ ID NO: 8919 - protein, 40 aa, Artificial Sequence
  Description of Artificial Sequence: Synthetic polypeptide
LAKMKQEPVKPEEGRDMANRIGAFGYMECSAKTKDGVREV

SEQ ID NO: 8920 - protein, 40 aa, Artificial Sequence
  Description of Artificial Sequence: Synthetic polypeptide
KMKQEPVKPEEGRDMANRIGAFGYMECSAKTKDGVREVFE

SEQ ID NO: 8921 - protein, 40 aa, Artificial Sequence
  Description of Artificial Sequence: Synthetic polypeptide
PVKPEEGRDMANRIGAFGYMECSAKTKDGVREVFEMATRA

SEQ ID NO: 8922 - protein, 40 aa, Artificial Sequence
  Description of Artificial Sequence: Synthetic polypeptide
EEGRDMANRIGAFGYMECSAKTKDGVREVFEMATRAALQA

SEQ ID NO: 8923 - protein, 40 aa, Artificial Sequence
  Description of Artificial Sequence: Synthetic polypeptide
RDMANRIGAFGYMECSAKTKDGVREVFEMATRAALQARRG

SEQ ID NO: 8924 - protein, 40 aa, Artificial Sequence
  Description of Artificial Sequence: Synthetic polypeptide
RIGAFGYMECSAKTKDGVREVFEMATRAALQARRGKKKSG

SEQ ID NO: 8925 - protein, 40 aa, Artificial Sequence
  Description of Artificial Sequence: Synthetic polypeptide
TAGQEEFGAMREQYMRTGEGFLLVFSVTDRGSFEEIYKFQ

SEQ ID NO: 8926 - protein, 40 aa, Artificial Sequence
  Description of Artificial Sequence: Synthetic polypeptide
AGQEEFGAMREQYMRTGEGFLLVFSVTDRGSFEEIYKFQR

SEQ ID NO: 8927 - protein, 40 aa, Artificial Sequence
  Description of Artificial Sequence: Synthetic polypeptide
MREQYMRTGEGFLLVFSVTDRGSFEEIYKFQRQILRVKDR

SEQ ID NO: 8928 - protein, 40 aa, Artificial Sequence
  Description of Artificial Sequence: Synthetic polypeptide
REQYMRTGEGFLLVFSVTDRGSFEEIYKFQRQILRVKDRD

SEQ ID NO: 8929 - protein, 40 aa, Artificial Sequence
  Description of Artificial Sequence: Synthetic polypeptide
QYMRTGEGFLLVFSVTDRGSFEEIYKFQRQILRVKDRDEF

SEQ ID NO: 8930 - protein, 40 aa, Artificial Sequence
  Description of Artificial Sequence: Synthetic polypeptide
TGEGFLLVFSVTDRGSFEEIYKFQRQILRVKDRDEFPMIL

SEQ ID NO: 8931 - protein, 40 aa, Artificial Sequence
  Description of Artificial Sequence: Synthetic polypeptide
FLLVFSVTDRGSFEEIYKFQRQILRVKDRDEFPMILIGNK

SEQ ID NO: 8932 - protein, 40 aa, Artificial Sequence
  Description of Artificial Sequence: Synthetic polypeptide
FSVTDRGSFEEIYKFQRQILRVKDRDEFPMILIGNKADLD

SEQ ID NO: 8933 - protein, 40 aa, Artificial Sequence
  Description of Artificial Sequence: Synthetic polypeptide
VTDRGSFEEIYKFQRQILRVKDRDEFPMILIGNKADLDHQ

SEQ ID NO: 8934 - protein, 40 aa, Artificial Sequence
  Description of Artificial Sequence: Synthetic polypeptide
RGSFEEIYKFQRQILRVKDRDEFPMILIGNKADLDHQRQV

SEQ ID NO: 8935 - protein, 40 aa, Artificial Sequence
  Description of Artificial Sequence: Synthetic polypeptide
FEEIYKFQRQILRVKDRDEFPMILIGNKADLDHQRQVTQE

SEQ ID NO: 8936 - protein, 40 aa, Artificial Sequence
  Description of Artificial Sequence: Synthetic polypeptide
YKFQRQILRVKDRDEFPMILIGNKADLDHQRQVTQEEGQQ

SEQ ID NO: 8937 - protein, 40 aa, Artificial Sequence
  Description of Artificial Sequence: Synthetic polypeptide
RQILRVKDRDEFPMILIGNKADLDHQRQVTQEEGQQLARQ

SEQ ID NO: 8938 - protein, 40 aa, Artificial Sequence
  Description of Artificial Sequence: Synthetic polypeptide
QILRVKDRDEFPMILIGNKADLDHQRQVTQEEGQQLARQL

SEQ ID NO: 8939 - protein, 40 aa, Artificial Sequence
  Description of Artificial Sequence: Synthetic polypeptide
VKDRDEFPMILIGNKADLDHQRQVTQEEGQQLARQLKVTY

SEQ ID NO: 8940 - protein, 40 aa, Artificial Sequence
  Description of Artificial Sequence: Synthetic polypeptide
RDEFPMILIGNKADLDHQRQVTQEEGQQLARQLKVTYMEA

SEQ ID NO: 8941 - protein, 40 aa, Artificial Sequence
  Description of Artificial Sequence: Synthetic polypeptide
EFPMILIGNKADLDHQRQVTQEEGQQLARQLKVTYMEASA

SEQ ID NO: 8942 - protein, 40 aa, Artificial Sequence
  Description of Artificial Sequence: Synthetic polypeptide
GNKADLDHQRQVTQEEGQQLARQLKVTYMEASAKIRMNVD

SEQ ID NO: 8943 - protein, 40 aa, Artificial Sequence
  Description of Artificial Sequence: Synthetic polypeptide
VTQEEGQQLARQLKVTYMEASAKIRMNVDQAFHELVRVIR

SEQ ID NO: 8944 - protein, 40 aa, Artificial Sequence
  Description of Artificial Sequence: Synthetic polypeptide
QEEGQQLARQLKVTYMEASAKIRMNVDQAFHELVRVIRKF

SEQ ID NO: 8945 - protein, 40 aa, Artificial Sequence
  Description of Artificial Sequence: Synthetic polypeptide
EEGQQLARQLKVTYMEASAKIRMNVDQAFHELVRVIRKFQ

SEQ ID NO: 8946 - protein, 40 aa, Artificial Sequence
  Description of Artificial Sequence: Synthetic polypeptide
QQLARQLKVTYMEASAKIRMNVDQAFHELVRVIRKFQEQE

SEQ ID NO: 8947 - protein, 40 aa, Artificial Sequence
  Description of Artificial Sequence: Synthetic polypeptide
QLARQLKVTYMEASAKIRMNVDQAFHELVRVIRKFQEQEC

SEQ ID NO: 8948 - protein, 40 aa, Artificial Sequence
  Description of Artificial Sequence: Synthetic polypeptide
VTYMEASAKIRMNVDQAFHELVRVIRKFQEQECPPSPEPT

SEQ ID NO: 8949 - protein, 40 aa, Artificial Sequence
  Description of Artificial Sequence: Synthetic polypeptide
MNVDQAFHELVRVIRKFQEQECPPSPEPTRKEKDKKGCHC

SEQ ID NO: 8950 - protein, 40 aa, Artificial Sequence
  Description of Artificial Sequence: Synthetic polypeptide
DASTSRRFTPPSTALSPGKMSEALPLGAPDAGAALAGKLR

SEQ ID NO: 8951 - protein, 40 aa, Artificial Sequence
  Description of Artificial Sequence: Synthetic polypeptide
DGTLVTVMAGNDENYSAELRNATAAMKNQVARFNDLRFVG

SEQ ID NO: 8952 - protein, 40 aa, Artificial Sequence
  Description of Artificial Sequence: Synthetic polypeptide
GTLVTVMAGNDENYSAELRNATAAMKNQVARFNDLRFVGR

SEQ ID NO: 8953 - protein, 40 aa, Artificial Sequence
  Description of Artificial Sequence: Synthetic polypeptide
TLVTVMAGNDENYSAELRNATAAMKNQVARFNDLRFVGRS

SEQ ID NO: 8954 - protein, 40 aa, Artificial Sequence
  Description of Artificial Sequence: Synthetic polypeptide
NDENYSAELRNATAAMKNQVARFNDLRFVGRSGRGKSFTL

SEQ ID NO: 8955 - protein, 40 aa, Artificial Sequence
  Description of Artificial Sequence: Synthetic polypeptide
REPRRHRQKLDDQTKPGSLSFSERLSELEQLRRTAMRVSP

SEQ ID NO: 8956 - protein, 40 aa, Artificial Sequence
  Description of Artificial Sequence: Synthetic polypeptide
PRRHRQKLDDQTKPGSLSFSERLSELEQLRRTAMRVSPHH

SEQ ID NO: 8957 - protein, 40 aa, Artificial Sequence
  Description of Artificial Sequence: Synthetic polypeptide
MTAFSDPRQFPALPSISDPRMHYPGAFTYSPTPVTSGIGI

SEQ ID NO: 8958 - protein, 40 aa, Artificial Sequence
  Description of Artificial Sequence: Synthetic polypeptide
PFQASSPSYHLYYGASAGSYQFSMVGGERSPPRILPPCTN

SEQ ID NO: 8959 - protein, 40 aa, Artificial Sequence
  Description of Artificial Sequence: Synthetic polypeptide
ASSPSYHLYYGASAGSYQFSMVGGERSPPRILPPCTNAST

SEQ ID NO: 8960 - protein, 40 aa, Artificial Sequence
  Description of Artificial Sequence: Synthetic polypeptide
SSPSYHLYYGASAGSYQFSMVGGERSPPRILPPCTNASTG

SEQ ID NO: 8961 - protein, 40 aa, Artificial Sequence
  Description of Artificial Sequence: Synthetic polypeptide
SPSYHLYYGASAGSYQFSMVGGERSPPRILPPCTNASTGS

SEQ ID NO: 8962 - protein, 40 aa, Artificial Sequence
  Description of Artificial Sequence: Synthetic polypeptide
PSYHLYYGASAGSYQFSMVGGERSPPRILPPCTNASTGSA

SEQ ID NO: 8963 - protein, 40 aa, Artificial Sequence
  Description of Artificial Sequence: Synthetic polypeptide
YHLYYGASAGSYQFSMVGGERSPPRILPPCTNASTGSALL

SEQ ID NO: 8964 - protein, 40 aa, Artificial Sequence
  Description of Artificial Sequence: Synthetic polypeptide
YYGASAGSYQFSMVGGERSPPRILPPCTNASTGSALLNPS

SEQ ID NO: 8965 - protein, 40 aa, Artificial Sequence
  Description of Artificial Sequence: Synthetic polypeptide
YGASAGSYQFSMVGGERSPPRILPPCTNASTGSALLNPSL

SEQ ID NO: 8966 - protein, 40 aa, Artificial Sequence
  Description of Artificial Sequence: Synthetic polypeptide
VGGERSPPRILPPCTNASTGSALLNPSLPNQSDVVEAEGS

SEQ ID NO: 8967 - protein, 40 aa, Artificial Sequence
  Description of Artificial Sequence: Synthetic polypeptide
AKIAKTHEDIEAQIREIQGKKAALDEAQGVGLDSTGYYDQ

SEQ ID NO: 8968 - protein, 40 aa, Artificial Sequence
  Description of Artificial Sequence: Synthetic polypeptide
HEDIEAQIREIQGKKAALDEAQGVGLDSTGYYDQEIYGGS

SEQ ID NO: 8969 - protein, 40 aa, Artificial Sequence
  Description of Artificial Sequence: Synthetic polypeptide
EDIEAQIREIQGKKAALDEAQGVGLDSTGYYDQEIYGGSD

SEQ ID NO: 8970 - protein, 40 aa, Artificial Sequence
  Description of Artificial Sequence: Synthetic polypeptide
EDEYKKHRRTMIISPERLDPFADGGKTPDPKMNARTYMDV

SEQ ID NO: 8971 - protein, 40 aa, Artificial Sequence
  Description of Artificial Sequence: Synthetic polypeptide
SPERLDPFADGGKTPDPKMNARTYMDVMREQHLTKEEREI

SEQ ID NO: 8972 - protein, 40 aa, Artificial Sequence
  Description of Artificial Sequence: Synthetic polypeptide
TPDPKMNARTYMDVMREQHLTKEEREIRQQLAEKAKAGEL

SEQ ID NO: 8973 - protein, 40 aa, Artificial Sequence
  Description of Artificial Sequence: Synthetic polypeptide
EQHLTKEEREIRQQLAEKAKAGELKVVNGAAASQPPSKRK

SEQ ID NO: 8974 - protein, 40 aa, Artificial Sequence
  Description of Artificial Sequence: Synthetic polypeptide
QHLTKEEREIRQQLAEKAKAGELKVVNGAAASQPPSKRKR

SEQ ID NO: 8975 - protein, 40 aa, Artificial Sequence
  Description of Artificial Sequence: Synthetic polypeptide
HLTKEEREIRQQLAEKAKAGELKVVNGAAASQPPSKRKRR

SEQ ID NO: 8976 - protein, 40 aa, Artificial Sequence
  Description of Artificial Sequence: Synthetic polypeptide
MTKEEREIRQQLAEKAKAGELKVVNGAAASQPPSKRKRRW

SEQ ID NO: 8977 - protein, 40 aa, Artificial Sequence
  Description of Artificial Sequence: Synthetic polypeptide
EEREIRQQLAEKAKAGELKVVNGAAASQPPSKRKRRWDQT

SEQ ID NO: 8978 - protein, 40 aa, Artificial Sequence
  Description of Artificial Sequence: Synthetic polypeptide
EREIRQQLAEKAKAGELKVVNGAAASQPPSKRKRRWDQTA

SEQ ID NO: 8979 - protein, 40 aa, Artificial Sequence
  Description of Artificial Sequence: Synthetic polypeptide
KGSETPGATPGSKIWDPTPSHTPAGAATPGRGDTPGHATP

SEQ ID NO: 8980 - protein, 40 aa, Artificial Sequence
  Description of Artificial Sequence: Synthetic polypeptide
GETPTPGASKRKSRWDETPASQMGGSTPVLTPGKTPIGTP

SEQ ID NO: 8981 - protein, 40 aa, Artificial Sequence
  Description of Artificial Sequence: Synthetic polypeptide
PTPGHIMSMTPEQLQAWRWEREIDERNRPLSDEELDAMFP

SEQ ID NO: 8982 - protein, 40 aa, Artificial Sequence
  Description of Artificial Sequence: Synthetic polypeptide
MSMTPEQLQAWRWEREIDERNRPLSDEELDAMFPEGYKVL

SEQ ID NO: 8983 - protein, 40 aa, Artificial Sequence
  Description of Artificial Sequence: Synthetic polypeptide
MTPEQLQAWRWEREIDERNRPLSDEELDAMFPEGYKVLPP

SEQ ID NO: 8984 - protein, 40 aa, Artificial Sequence
  Description of Artificial Sequence: Synthetic polypeptide
PEQLQAWRWEREIDERNRPLSDEELDAMFPEGYKVLPPPA

SEQ ID NO: 8985 - protein, 40 aa, Artificial Sequence
  Description of Artificial Sequence: Synthetic polypeptide
AWRWEREIDERNRPLSDEELDAMFPEGYKVLPPPAGYVPI

SEQ ID NO: 8986 - protein, 40 aa, Artificial Sequence
  Description of Artificial Sequence: Synthetic polypeptide
PLSDEELDAMFPEGYKVLPPPAGYVPIRTPARKLTATPTP

SEQ ID NO: 8987 - protein, 40 aa, Artificial Sequence
  Description of Artificial Sequence: Synthetic polypeptide
PEGYKVLPPPAGYVPIRTPARKLTATPTPLGGMTGFHMQT

SEQ ID NO: 8988 - protein, 40 aa, Artificial Sequence
  Description of Artificial Sequence: Synthetic polypeptide
RTMKSVNDQPSGNLPFLKPDDIQYFDKLLVDVDESTLSPE

SEQ ID NO: 8989 - protein, 40 aa, Artificial Sequence
  Description of Artificial Sequence: Synthetic polypeptide
DQPSGNLPFLKPDDIQYFDKLLVDVDESTLSPEEQKERKI

SEQ ID NO: 8990 - protein, 40 aa, Artificial Sequence
  Description of Artificial Sequence: Synthetic polypeptide
NLPFLKPDDIQYFDKLLVDVDESTLSPEEQKERKIMKLLL

SEQ ID NO: 8991 - protein, 40 aa, Artificial Sequence
  Description of Artificial Sequence: Synthetic polypeptide
LPFLKPDDIQYFDKLLVDVDESTLSPEEQKERKIMKLLLK

SEQ ID NO: 8992 - protein, 40 aa, Artificial Sequence
  Description of Artificial Sequence: Synthetic polypeptide
PDDIQYFDKLLVDVDESTLSPEEQKERKIMKLLLKIKNGT

SEQ ID NO: 8993 - protein, 40 aa, Artificial Sequence
  Description of Artificial Sequence: Synthetic polypeptide
DDIQYFDKLLVDVDESTLSPEEQKERKIMKLLLKIKNGTP

SEQ ID NO: 8994 - protein, 40 aa, Artificial Sequence
  Description of Artificial Sequence: Synthetic polypeptide
DIQYFDKLLVDVDESTLSPEEQKERKIMKLLLKIKNGTPP

SEQ ID NO: 8995 - protein, 40 aa, Artificial Sequence
  Description of Artificial Sequence: Synthetic polypeptide
KLLVDVDESTLSPEEQKERKIMKLLLKIKNGTPPMRKAAL

SEQ ID NO: 8996 - protein, 40 aa, Artificial Sequence
  Description of Artificial Sequence: Synthetic polypeptide
LLVDVDESTLSPEEQKERKIMKLLLKIKNGTPPMRKAALR

SEQ ID NO: 8997 - protein, 40 aa, Artificial Sequence
  Description of Artificial Sequence: Synthetic polypeptide
VDVDESTLSPEEQKERKIMKLLLKIKNGTPPMRKAALRQI

SEQ ID NO: 8998 - protein, 40 aa, Artificial Sequence
  Description of Artificial Sequence: Synthetic polypeptide
VDESTLSPEEQKERKIMKLLLKIKNGTPPMRKAALRQITD

SEQ ID NO: 8999 - protein, 40 aa, Artificial Sequence
  Description of Artificial Sequence: Synthetic polypeptide
DESTLSPEEQKERKIMKLLLKIKNGTPPMRKAALRQITDK

SEQ ID NO: 9000 - protein, 40 aa, Artificial Sequence
  Description of Artificial Sequence: Synthetic polypeptide
ESTLSPEEQKERKIMKLLLKIKNGTPPMRKAALRQITDKA

SEQ ID NO: 9001 - protein, 40 aa, Artificial Sequence
  Description of Artificial Sequence: Synthetic polypeptide
STLSPEEQKERKIMKLLLKIKNGTPPMRKAALRQITDKAR

SEQ ID NO: 9002 - protein, 40 aa, Artificial Sequence
  Description of Artificial Sequence: Synthetic polypeptide
TLSPEEQKERKIMKLLLKIKNGTPPMRKAALRQITDKARE

SEQ ID NO: 9003 - protein, 40 aa, Artificial Sequence
  Description of Artificial Sequence: Synthetic polypeptide
LSPEEQKERKIMKLLLKIKNGTPPMRKAALRQITDKAREF

SEQ ID NO: 9004 - protein, 40 aa, Artificial Sequence
  Description of Artificial Sequence: Synthetic polypeptide
SPEEQKERKIMKLLLKIKNGTPPMRKAALRQITDKAREFG

SEQ ID NO: 9005 - protein, 40 aa, Artificial Sequence
  Description of Artificial Sequence: Synthetic polypeptide
PEEQKERKIMKLLLKIKNGTPPMRKAALRQITDKAREFGA

SEQ ID NO: 9006 - protein, 40 aa, Artificial Sequence
  Description of Artificial Sequence: Synthetic polypeptide
EEQKERKIMKLLLKIKNGTPPMRKAALRQITDKAREFGAG

SEQ ID NO: 9007 - protein, 40 aa, Artificial Sequence
  Description of Artificial Sequence: Synthetic polypeptide
MKLLLKIKNGTPPMRKAALRQITDKAREFGAGPLFNQILP

SEQ ID NO: 9008 - protein, 40 aa, Artificial Sequence
  Description of Artificial Sequence: Synthetic polypeptide
LLKIKNGTPPMRKAALRQITDKAREFGAGPLFNQILPLLM

SEQ ID NO: 9009 - protein, 40 aa, Artificial Sequence
  Description of Artificial Sequence: Synthetic polypeptide
KAALRQITDKAREFGAGPLFNQILPLLMSPTLEDQERHLL

SEQ ID NO: 9010 - protein, 40 aa, Artificial Sequence
  Description of Artificial Sequence: Synthetic polypeptide
ALRQITDKAREFGAGPLFNQILPLLMSPTLEDQERHLLVK

SEQ ID NO: 9011 - protein, 40 aa, Artificial Sequence
  Description of Artificial Sequence: Synthetic polypeptide
MRQITDKAREFGAGPLFNQILPLLMSPTLEDQERHLLVKV

SEQ ID NO: 9012 - protein, 40 aa, Artificial Sequence
  Description of Artificial Sequence: Synthetic polypeptide
QITDKAREFGAGPLFNQILPLLMSPTLEDQERHLLVKVID

SEQ ID NO: 9013 - protein, 40 aa, Artificial Sequence
  Description of Artificial Sequence: Synthetic polypeptide
ITDKAREFGAGPLFNQILPLLMSPTLEDQERHLLVKVIDR

SEQ ID NO: 9014 - protein, 40 aa, Artificial Sequence
  Description of Artificial Sequence: Synthetic polypeptide
KAREFGAGPLFNQILPLLMSPTLEDQERHLLVKVIDRILY

SEQ ID NO: 9015 - protein, 40 aa, Artificial Sequence
  Description of Artificial Sequence: Synthetic polypeptide
AREFGAGPLFNQILPLLMSPTLEDQERHLLVKVIDRILYK

SEQ ID NO: 9016 - protein, 40 aa, Artificial Sequence
  Description of Artificial Sequence: Synthetic polypeptide
REFGAGPLFNQILPLLMSPTLEDQERHLLVKVIDRILYKL

SEQ ID NO: 9017 - protein, 40 aa, Artificial Sequence
  Description of Artificial Sequence: Synthetic polypeptide
EFGAGPLFNQILPLLMSPTLEDQERHLLVKVIDRILYKLD

SEQ ID NO: 9018 - protein, 40 aa, Artificial Sequence
  Description of Artificial Sequence: Synthetic polypeptide
GAGPLFNQILPLLMSPTLEDQERHLLVKVIDRILYKLDDL

SEQ ID NO: 9019 - protein, 40 aa, Artificial Sequence
  Description of Artificial Sequence: Synthetic polypeptide
GPLFNQILPLLMSPTLEDQERHLLVKVIDRILYKLDDLVR

SEQ ID NO: 9020 - protein, 40 aa, Artificial Sequence
  Description of Artificial Sequence: Synthetic polypeptide
PLFNQILPLLMSPTLEDQERHLLVKVIDRILYKLDDLVRP

SEQ ID NO: 9021 - protein, 40 aa, Artificial Sequence
  Description of Artificial Sequence: Synthetic polypeptide
MFNQILPLLMSPTLEDQERHLLVKVIDRILYKLDDLVRPY

SEQ ID NO: 9022 - protein, 40 aa, Artificial Sequence
  Description of Artificial Sequence: Synthetic polypeptide
ILPLLMSPTLEDQERHLLVKVIDRILYKLDDLVRPYVHKI

SEQ ID NO: 9023 - protein, 40 aa, Artificial Sequence
  Description of Artificial Sequence: Synthetic polypeptide
PLLMSPTLEDQERHLLVKVIDRILYKLDDLVRPYVHKILV

SEQ ID NO: 9024 - protein, 40 aa, Artificial Sequence
  Description of Artificial Sequence: Synthetic polypeptide
MMSPTLEDQERHLLVKVIDRILYKLDDLVRPYVHKILVVI

SEQ ID NO: 9025 - protein, 40 aa, Artificial Sequence
  Description of Artificial Sequence: Synthetic polypeptide
TLEDQERHLLVKVIDRILYKLDDLVRPYVHKILVVIEPLL

SEQ ID NO: 9026 - protein, 40 aa, Artificial Sequence
  Description of Artificial Sequence: Synthetic polypeptide
LEDQERHLLVKVIDRILYKLDDLVRPYVHKILVVIEPLLI

SEQ ID NO: 9027 - protein, 40 aa, Artificial Sequence
  Description of Artificial Sequence: Synthetic polypeptide
VIDRILYKLDDLVRPYVHKILVVIEPLLIDEDYYARVEGR

SEQ ID NO: 9028 - protein, 40 aa, Artificial Sequence
  Description of Artificial Sequence: Synthetic polypeptide
ILYKLDDLVRPYVHKILVVIEPLLIDEDYYARVEGREIIS

SEQ ID NO: 9029 - protein, 40 aa, Artificial Sequence
  Description of Artificial Sequence: Synthetic polypeptide
DLVRPYVHKILVVIEPLLIDEDYYARVEGREIISNLAKAA

SEQ ID NO: 9030 - protein, 40 aa, Artificial Sequence
  Description of Artificial Sequence: Synthetic polypeptide
PDIDNMDEYVRNTTARAFAVVASALGIPSLLPFLKAVCKS

SEQ ID NO: 9031 - protein, 40 aa, Artificial Sequence
  Description of Artificial Sequence: Synthetic polypeptide
DEYVRNTTARAFAVVASALGIPSLLPFLKAVCKSKKSWQA

SEQ ID NO: 9032 - protein, 40 aa, Artificial Sequence
  Description of Artificial Sequence: Synthetic polypeptide
LLPFLKAVCKSKKSWQARHTGIKIVQQIAILMGCAILPHL

SEQ ID NO: 9033 - protein, 40 aa, Artificial Sequence
  Description of Artificial Sequence: Synthetic polypeptide
MPFLKAVCKSKKSWQARHTGIKIVQQIAILMGCAILPHLR

SEQ ID NO: 9034 - protein, 40 aa, Artificial Sequence
  Description of Artificial Sequence: Synthetic polypeptide
LKAVCKSKKSWQARHTGIKIVQQIAILMGCAILPHLRSLV

SEQ ID NO: 9035 - protein, 40 aa, Artificial Sequence
  Description of Artificial Sequence: Synthetic polypeptide
CKSKKSWQARHTGIKIVQQIAILMGCAILPHLRSLVEIIE

SEQ ID NO: 9036 - protein, 40 aa, Artificial Sequence
  Description of Artificial Sequence: Synthetic polypeptide
SWQARHTGIKIVQQIAILMGCAILPHLRSLVEIIEHGLVD

SEQ ID NO: 9037 - protein, 40 aa, Artificial Sequence
  Description of Artificial Sequence: Synthetic polypeptide
ARHTGIKIVQQIAILMGCAILPHLRSLVEIIEHGLVDEQQ

SEQ ID NO: 9038 - protein, 40 aa, Artificial Sequence
  Description of Artificial Sequence: Synthetic polypeptide
GIKIVQQIAILMGCAILPHLRSLVEIIEHGLVDEQQKVRT

SEQ ID NO: 9039 - protein, 40 aa, Artificial Sequence
  Description of Artificial Sequence: Synthetic polypeptide
VQQIAILMGCAILPHLRSLVEIIEHGLVDEQQKVRTISAL

SEQ ID NO: 9040 - protein, 40 aa, Artificial Sequence
  Description of Artificial Sequence: Synthetic polypeptide
QQIAILMGCAILPHLRSLVEIIEHGLVDEQQKVRTISALA

SEQ ID NO: 9041 - protein, 40 aa, Artificial Sequence
  Description of Artificial Sequence: Synthetic polypeptide
QIAILMGCAILPHLRSLVEIIEHGLVDEQQKVRTISALAI

SEQ ID NO: 9042 - protein, 40 aa, Artificial Sequence
  Description of Artificial Sequence: Synthetic polypeptide
CAILPHLRSLVEIIEHGLVDEQQKVRTISALAIAALAEAA

SEQ ID NO: 9043 - protein, 40 aa, Artificial Sequence
  Description of Artificial Sequence: Synthetic polypeptide
IIEHGLVDEQQKVRTISALAIAALAEAATPYGIESFDSVL

SEQ ID NO: 9044 - protein, 40 aa, Artificial Sequence
  Description of Artificial Sequence: Synthetic polypeptide
HGLVDEQQKVRTISALAIAALAEAATPYGIESFDSVLKPL

SEQ ID NO: 9045 - protein, 40 aa, Artificial Sequence
  Description of Artificial Sequence: Synthetic polypeptide
GLVDEQQKVRTISALAIAALAEAATPYGIESFDSVLKPLW

SEQ ID NO: 9046 - protein, 40 aa, Artificial Sequence
  Description of Artificial Sequence: Synthetic polypeptide
RTISALAIAALAEAATPYGIESFDSVLKPLWKGIRQHRGK

SEQ ID NO: 9047 - protein, 40 aa, Artificial Sequence
  Description of Artificial Sequence: Synthetic polypeptide
AIAALAEAATPYGIESFDSVLKPLWKGIRQHRGKGLAAFL

SEQ ID NO: 9048 - protein, 40 aa, Artificial Sequence
  Description of Artificial Sequence: Synthetic polypeptide
AALAEAATPYGIESFDSVLKPLWKGIRQHRGKGLAAFLKA

SEQ ID NO: 9049 - protein, 40 aa, Artificial Sequence
  Description of Artificial Sequence: Synthetic polypeptide
ALAEAATPYGIESFDSVLKPLWKGIRQHRGKGLAAFLKAI

SEQ ID NO: 9050 - protein, 40 aa, Artificial Sequence
  Description of Artificial Sequence: Synthetic polypeptide
EAATPYGIESFDSVLKPLWKGIRQHRGKGLAAFLKAIGYL

SEQ ID NO: 9051 - protein, 40 aa, Artificial Sequence
  Description of Artificial Sequence: Synthetic polypeptide
TPYGIESFDSVLKPLWKGIRQHRGKGLAAFLKAIGYLIPL

SEQ ID NO: 9052 - protein, 40 aa, Artificial Sequence
  Description of Artificial Sequence: Synthetic polypeptide
DSVLKPLWKGIRQHRGKGLAAFLKAIGYLIPLMDAEYANY

SEQ ID NO: 9053 - protein, 40 aa, Artificial Sequence
  Description of Artificial Sequence: Synthetic polypeptide
KPLWKGIRQHRGKGLAAFLKAIGYLIPLMDAEYANYYTRE

SEQ ID NO: 9054 - protein, 40 aa, Artificial Sequence
  Description of Artificial Sequence: Synthetic polypeptide
IRQHRGKGLAAFLKAIGYLIPLMDAEYANYYTREVMLILI

SEQ ID NO: 9055 - protein, 40 aa, Artificial Sequence
  Description of Artificial Sequence: Synthetic polypeptide
RGKGLAAFLKAIGYLIPLMDAEYANYYTREVMLILIREFQ

SEQ ID NO: 9056 - protein, 40 aa, Artificial Sequence
  Description of Artificial Sequence: Synthetic polypeptide
MAAFLKAIGYLIPLMDAEYANYYTREVMLILIREFQSPDE

SEQ ID NO: 9057 - protein, 40 aa, Artificial Sequence
  Description of Artificial Sequence: Synthetic polypeptide
IGYLIPLMDAEYANYYTREVMLILIREFQSPDEEMKKIVL

SEQ ID NO: 9058 - protein, 40 aa, Artificial Sequence
  Description of Artificial Sequence: Synthetic polypeptide
GYLIPLMDAEYANYYTREVMLILIREFQSPDEEMKKIVLK

SEQ ID NO: 9059 - protein, 40 aa, Artificial Sequence
  Description of Artificial Sequence: Synthetic polypeptide
LIPLMDAEYANYYTREVMLILIREFQSPDEEMKKIVLKVV

SEQ ID NO: 9060 - protein, 40 aa, Artificial Sequence
  Description of Artificial Sequence: Synthetic polypeptide
PLMDAEYANYYTREVMLILIREFQSPDEEMKKIVLKVVKQ

SEQ ID NO: 9061 - protein, 40 aa, Artificial Sequence
  Description of Artificial Sequence: Synthetic polypeptide
DAEYANYYTREVMLILIREFQSPDEEMKKIVLKVVKQCCG

SEQ ID NO: 9062 - protein, 40 aa, Artificial Sequence
  Description of Artificial Sequence: Synthetic polypeptide
AEYANYYTREVMLILIREFQSPDEEMKKIVLKVVKQCCGT

SEQ ID NO: 9063 - protein, 40 aa, Artificial Sequence
  Description of Artificial Sequence: Synthetic polypeptide
MLILIREFQSPDEEMKKIVLKVVKQCCGTDGVEANYIKTE

SEQ ID NO: 9064 - protein, 40 aa, Artificial Sequence
  Description of Artificial Sequence: Synthetic polypeptide
LIREFQSPDEEMKKIVLKVVKQCCGTDGVEANYIKTEILP

SEQ ID NO: 9065 - protein, 40 aa, Artificial Sequence
  Description of Artificial Sequence: Synthetic polypeptide
SPDEEMKKIVLKVVKQCCGTDGVEANYIKTEILPPFFKHF

SEQ ID NO: 9066 - protein, 40 aa, Artificial Sequence
  Description of Artificial Sequence: Synthetic polypeptide
DEEMKKIVLKVVKQCCGTDGVEANYIKTEILPPFFKHFWQ

SEQ ID NO: 9067 - protein, 40 aa, Artificial Sequence
  Description of Artificial Sequence: Synthetic polypeptide
EMKKIVLKVVKQCCGTDGVEANYIKTEILPPFFKHFWQHR

SEQ ID NO: 9068 - protein, 40 aa, Artificial Sequence
  Description of Artificial Sequence: Synthetic polypeptide
KKIVLKVVKQCCGTDGVEANYIKTEILPPFFKHFWQHRMA

SEQ ID NO: 9069 - protein, 40 aa, Artificial Sequence
  Description of Artificial Sequence: Synthetic polypeptide
VLKVVKQCCGTDGVEANYIKTEILPPFFKHFWQHRMALDR

SEQ ID NO: 9070 - protein, 40 aa, Artificial Sequence
  Description of Artificial Sequence: Synthetic polypeptide
KVVKQCCGTDGVEANYIKTEILPPFFKHFWQHRMALDRRN

SEQ ID NO: 9071 - protein, 40 aa, Artificial Sequence
  Description of Artificial Sequence: Synthetic polypeptide
QCCGTDGVEANYIKTEILPPFFKHFWQHRMALDRRNYRQL

SEQ ID NO: 9072 - protein, 40 aa, Artificial Sequence
  Description of Artificial Sequence: Synthetic polypeptide
EANYIKTEILPPFFKHFWQHRMALDRRNYRQLVDTTVELA

SEQ ID NO: 9073 - protein, 40 aa, Artificial Sequence
  Description of Artificial Sequence: Synthetic polypeptide
ANYIKTEILPPFFKHFWQHRMALDRRNYRQLVDTTVELAN

SEQ ID NO: 9074 - protein, 40 aa, Artificial Sequence
  Description of Artificial Sequence: Synthetic polypeptide
NYIKTEILPPFFKHFWQHRMALDRRNYRQLVDTTVELANK

SEQ ID NO: 9075 - protein, 40 aa, Artificial Sequence
  Description of Artificial Sequence: Synthetic polypeptide
EILPPFFKHFWQHRMALDRRNYRQLVDTTVELANKVGAAE

SEQ ID NO: 9076 - protein, 40 aa, Artificial Sequence
  Description of Artificial Sequence: Synthetic polypeptide
KHFWQHRMALDRRNYRQLVDTTVELANKVGAAEIISRIVD

SEQ ID NO: 9077 - protein, 40 aa, Artificial Sequence
  Description of Artificial Sequence: Synthetic polypeptide
WQHRMALDRRNYRQLVDTTVELANKVGAAEIISRIVDDLK

SEQ ID NO: 9078 - protein, 40 aa, Artificial Sequence
  Description of Artificial Sequence: Synthetic polypeptide
MDRRNYRQLVDTTVELANKVGAAEIISRIVDDLKDEAEQY

SEQ ID NO: 9079 - protein, 40 aa, Artificial Sequence
  Description of Artificial Sequence: Synthetic polypeptide
QLVDTTVELANKVGAAEIISRIVDDLKDEAEQYRKMVMET

SEQ ID NO: 9080 - protein, 40 aa, Artificial Sequence
  Description of Artificial Sequence: Synthetic polypeptide
ANKVGAAEIISRIVDDLKDEAEQYRKMVMETIEKIMGNLG

SEQ ID NO: 9081 - protein, 40 aa, Artificial Sequence
  Description of Artificial Sequence: Synthetic polypeptide
NKVGAAEIISRIVDDLKDEAEQYRKMVMETIEKIMGNLGA

SEQ ID NO: 9082 - protein, 40 aa, Artificial Sequence
  Description of Artificial Sequence: Synthetic polypeptide
AEIISRIVDDLKDEAEQYRKMVMETIEKIMGNLGAADIDH

SEQ ID NO: 9083 - protein, 40 aa, Artificial Sequence
  Description of Artificial Sequence: Synthetic polypeptide
IVDDLKDEAEQYRKMVMETIEKIMGNLGAADIDHKLEEQL

SEQ ID NO: 9084 - protein, 40 aa, Artificial Sequence
  Description of Artificial Sequence: Synthetic polypeptide
MKDEAEQYRKMVMETIEKIMGNLGAADIDHKLEEQLIDGI

SEQ ID NO: 9085 - protein, 40 aa, Artificial Sequence
  Description of Artificial Sequence: Synthetic polypeptide
AEQYRKMVMETIEKIMGNLGAADIDHKLEEQLIDGILYAF

SEQ ID NO: 9086 - protein, 40 aa, Artificial Sequence
  Description of Artificial Sequence: Synthetic polypeptide
RKMVMETIEKIMGNLGAADIDHKLEEQLIDGILYAFQEQT

SEQ ID NO: 9087 - protein, 40 aa, Artificial Sequence
  Description of Artificial Sequence: Synthetic polypeptide
IMGNLGAADIDHKLEEQLIDGILYAFQEQTTEDSVMLNGF

SEQ ID NO: 9088 - protein, 40 aa, Artificial Sequence
  Description of Artificial Sequence: Synthetic polypeptide
IDHKLEEQLIDGILYAFQEQTTEDSVMLNGFGTVVNALGK

SEQ ID NO: 9089 - protein, 40 aa, Artificial Sequence
  Description of Artificial Sequence: Synthetic polypeptide
EDSVMLNGFGTVVNALGKRVKPYLPQICGTVLWRLNNKSA

SEQ ID NO: 9090 - protein, 40 aa, Artificial Sequence
  Description of Artificial Sequence: Synthetic polypeptide
SVMLNGFGTVVNALGKRVKPYLPQICGTVLWRLNNKSAKV

SEQ ID NO: 9091 - protein, 40 aa, Artificial Sequence
  Description of Artificial Sequence: Synthetic polypeptide
GFGTVVNALGKRVKPYLPQICGTVLWRLNNKSAKVRQQAA

SEQ ID NO: 9092 - protein, 40 aa, Artificial Sequence
  Description of Artificial Sequence: Synthetic polypeptide
VNALGKRVKPYLPQICGTVLWRLNNKSAKVRQQAADLISR

SEQ ID NO: 9093 - protein, 40 aa, Artificial Sequence
  Description of Artificial Sequence: Synthetic polypeptide
NALGKRVKPYLPQICGTVLWRLNNKSAKVRQQAADLISRT

SEQ ID NO: 9094 - protein, 40 aa, Artificial Sequence
  Description of Artificial Sequence: Synthetic polypeptide
ALGKRVKPYLPQICGTVLWRLNNKSAKVRQQAADLISRTA

SEQ ID NO: 9095 - protein, 40 aa, Artificial Sequence
  Description of Artificial Sequence: Synthetic polypeptide
KPYLPQICGTVLWRLNNKSAKVRQQAADLISRTAVVMKTC

SEQ ID NO: 9096 - protein, 40 aa, Artificial Sequence
  Description of Artificial Sequence: Synthetic polypeptide
AADLISRTAVVMKTCQEEKLMGHLGVVLYEYLGEEYPEVL

SEQ ID NO: 9097 - protein, 40 aa, Artificial Sequence
  Description of Artificial Sequence: Synthetic polypeptide
ISRTAVVMKTCQEEKLMGHLGVVLYEYLGEEYPEVLGSIL

SEQ ID NO: 9098 - protein, 40 aa, Artificial Sequence
  Description of Artificial Sequence: Synthetic polypeptide
TAVVMKTCQEEKLMGHLGVVLYEYLGEEYPEVLGSILGAL

SEQ ID NO: 9099 - protein, 40 aa, Artificial Sequence
  Description of Artificial Sequence: Synthetic polypeptide
VVMKTCQEEKLMGHLGVVLYEYLGEEYPEVLGSILGALKA

SEQ ID NO: 9100 - protein, 40 aa, Artificial Sequence
  Description of Artificial Sequence: Synthetic polypeptide
CQEEKLMGHLGVVLYEYLGEEYPEVLGSILGALKAIVNVI

SEQ ID NO: 9101 - protein, 40 aa, Artificial Sequence
  Description of Artificial Sequence: Synthetic polypeptide
EEKLMGHLGVVLYEYLGEEYPEVLGSILGALKAIVNVIGM

SEQ ID NO: 9102 - protein, 40 aa, Artificial Sequence
  Description of Artificial Sequence: Synthetic polypeptide
GHLGVVLYEYLGEEYPEVLGSILGALKAIVNVIGMHKMTP

SEQ ID NO: 9103 - protein, 40 aa, Artificial Sequence
  Description of Artificial Sequence: Synthetic polypeptide
HLGVVLYEYLGEEYPEVLGSILGALKAIVNVIGMHKMTPP

SEQ ID NO: 9104 - protein, 40 aa, Artificial Sequence
  Description of Artificial Sequence: Synthetic polypeptide
VLYEYLGEEYPEVLGSILGALKAIVNVIGMHKMTPPIKDL

SEQ ID NO: 9105 - protein, 40 aa, Artificial Sequence
  Description of Artificial Sequence: Synthetic polypeptide
MYEYLGEEYPEVLGSILGALKAIVNVIGMHKMTPPIKDLL

SEQ ID NO: 9106 - protein, 40 aa, Artificial Sequence
  Description of Artificial Sequence: Synthetic polypeptide
YEYLGEEYPEVLGSILGALKAIVNVIGMHKMTPPIKDLLP

SEQ ID NO: 9107 - protein, 40 aa, Artificial Sequence
  Description of Artificial Sequence: Synthetic polypeptide
EKVQENCIDLVGRIADRGAEYVSAREWMRICFELLELLKA

SEQ ID NO: 9108 - protein, 40 aa, Artificial Sequence
  Description of Artificial Sequence: Synthetic polypeptide
GAEYVSAREWMRICFELLELLKAHKKAIRRATVNTFGYIA

SEQ ID NO: 9109 - protein, 40 aa, Artificial Sequence
  Description of Artificial Sequence: Synthetic polypeptide
REWMRICFELLELLKAHKKAIRRATVNTFGYIAKAIGPHD

SEQ ID NO: 9110 - protein, 40 aa, Artificial Sequence
  Description of Artificial Sequence: Synthetic polypeptide
CFELLELLKAHKKAIRRATVNTFGYIAKAIGPHDVLATLL

SEQ ID NO: 9111 - protein, 40 aa, Artificial Sequence
  Description of Artificial Sequence: Synthetic polypeptide
LELLKAHKKAIRRATVNTFGYIAKAIGPHDVLATLLNNLK

SEQ ID NO: 9112 - protein, 40 aa, Artificial Sequence
  Description of Artificial Sequence: Synthetic polypeptide
ELLKAHKKAIRRATVNTFGYIAKAIGPHDVLATLLNNLKV

SEQ ID NO: 9113 - protein, 40 aa, Artificial Sequence
  Description of Artificial Sequence: Synthetic polypeptide
KKAIRRATVNTFGYIAKAIGPHDVLATLLNNLKVQERQNR

SEQ ID NO: 9114 - protein, 40 aa, Artificial Sequence
  Description of Artificial Sequence: Synthetic polypeptide
AIRRATVNTFGYIAKAIGPHDVLATLLNNLKVQERQNRVC

SEQ ID NO: 9115 - protein, 40 aa, Artificial Sequence
  Description of Artificial Sequence: Synthetic polypeptide
IRRATVNTFGYIAKAIGPHDVLATLLNNLKVQERQNRVCT

SEQ ID NO: 9116 - protein, 40 aa, Artificial Sequence
  Description of Artificial Sequence: Synthetic polypeptide
RATVNTFGYIAKAIGPHDVLATLLNNLKVQERQNRVCTTV

SEQ ID NO: 9117 - protein, 40 aa, Artificial Sequence
  Description of Artificial Sequence: Synthetic polypeptide
KAIGPHDVLATLLNNLKVQERQNRVCTTVAIAIVAETCSP

SEQ ID NO: 9118 - protein, 40 aa, Artificial Sequence
  Description of Artificial Sequence: Synthetic polypeptide
RQNRVCTTVAIAIVAETCSPFTVLPALMNEYRVPELNVQN

SEQ ID NO: 9119 - protein, 40 aa, Artificial Sequence
  Description of Artificial Sequence: Synthetic polypeptide
TTVAIAIVAETCSPFTVLPALMNEYRVPELNVQNGVLKSL

SEQ ID NO: 9120 - protein, 40 aa, Artificial Sequence
  Description of Artificial Sequence: Synthetic polypeptide
TVAIAIVAETCSPFTVLPALMNEYRVPELNVQNGVLKSLS

SEQ ID NO: 9121 - protein, 40 aa, Artificial Sequence
  Description of Artificial Sequence: Synthetic polypeptide
VAIAIVAETCSPFTVLPALMNEYRVPELNVQNGVLKSLSF

SEQ ID NO: 9122 - protein, 40 aa, Artificial Sequence
  Description of Artificial Sequence: Synthetic polypeptide
IAIVAETCSPFTVLPALMNEYRVPELNVQNGVLKSLSFLF

SEQ ID NO: 9123 - protein, 40 aa, Artificial Sequence
  Description of Artificial Sequence: Synthetic polypeptide
AIVAETCSPFTVLPALMNEYRVPELNVQNGVLKSLSFLFE

SEQ ID NO: 9124 - protein, 40 aa, Artificial Sequence
  Description of Artificial Sequence: Synthetic polypeptide
IVAETCSPFTVLPALMNEYRVPELNVQNGVLKSLSFLFEY

SEQ ID NO: 9125 - protein, 40 aa, Artificial Sequence
  Description of Artificial Sequence: Synthetic polypeptide
AETCSPFTVLPALMNEYRVPELNVQNGVLKSLSFLFEYIG

SEQ ID NO: 9126 - protein, 40 aa, Artificial Sequence
  Description of Artificial Sequence: Synthetic polypeptide
TCSPFTVLPALMNEYRVPELNVQNGVLKSLSFLFEYIGEM

SEQ ID NO: 9127 - protein, 40 aa, Artificial Sequence
  Description of Artificial Sequence: Synthetic polypeptide
SPFTVLPALMNEYRVPELNVQNGVLKSLSFLFEYIGEMGK

SEQ ID NO: 9128 - protein, 40 aa, Artificial Sequence
  Description of Artificial Sequence: Synthetic polypeptide
YRVPELNVQNGVLKSLSFLFEYIGEMGKDYIYAVTPLLED

SEQ ID NO: 9129 - protein, 40 aa, Artificial Sequence
  Description of Artificial Sequence: Synthetic polypeptide
ELNVQNGVLKSLSFLFEYIGEMGKDYIYAVTPLLEDALMD

SEQ ID NO: 9130 - protein, 40 aa, Artificial Sequence
  Description of Artificial Sequence: Synthetic polypeptide
NVQNGVLKSLSFLFEYIGEMGKDYIYAVTPLLEDALMDRD

SEQ ID NO: 9131 - protein, 40 aa, Artificial Sequence
  Description of Artificial Sequence: Synthetic polypeptide
VQNGVLKSLSFLFEYIGEMGKDYIYAVTPLLEDALMDRDL

SEQ ID NO: 9132 - protein, 40 aa, Artificial Sequence
  Description of Artificial Sequence: Synthetic polypeptide
QNGVLKSLSFLFEYIGEMGKDYIYAVTPLLEDALMDRDLV

SEQ ID NO: 9133 - protein, 40 aa, Artificial Sequence
  Description of Artificial Sequence: Synthetic polypeptide
YIGEMGKDYIYAVTPLLEDALMDRDLVHRQTASAVVQHMS

SEQ ID NO: 9134 - protein, 40 aa, Artificial Sequence
  Description of Artificial Sequence: Synthetic polypeptide
DALMDRDLVHRQTASAVVQHMSLGVYGFGCEDSLNHLLNY

SEQ ID NO: 9135 - protein, 40 aa, Artificial Sequence
  Description of Artificial Sequence: Synthetic polypeptide
HRQTASAVVQHMSLGVYGFGCEDSLNHLLNYVWPNVFETS

SEQ ID NO: 9136 - protein, 40 aa, Artificial Sequence
  Description of Artificial Sequence: Synthetic polypeptide
RQTASAVVQHMSLGVYGFGCEDSLNHLLNYVWPNVFETSP

SEQ ID NO: 9137 - protein, 40 aa, Artificial Sequence
  Description of Artificial Sequence: Synthetic polypeptide
TASAVVQHMSLGVYGFGCEDSLNHLLNYVWPNVFETSPHV

SEQ ID NO: 9138 - protein, 40 aa, Artificial Sequence
  Description of Artificial Sequence: Synthetic polypeptide
ASAVVQHMSLGVYGFGCEDSLNHLLNYVWPNVFETSPHVI

SEQ ID NO: 9139 - protein, 40 aa, Artificial Sequence
  Description of Artificial Sequence: Synthetic polypeptide
HMSLGVYGFGCEDSLNHLLNYVWPNVFETSPHVIQAVMGA

SEQ ID NO: 9140 - protein, 40 aa, Artificial Sequence
  Description of Artificial Sequence: Synthetic polypeptide
SLGVYGFGCEDSLNHLLNYVWPNVFETSPHVIQAVMGALE

SEQ ID NO: 9141 - protein, 40 aa, Artificial Sequence
  Description of Artificial Sequence: Synthetic polypeptide
SLNHLLNYVWPNVFETSPHVIQAVMGALEGLRVAIGPCRM

SEQ ID NO: 9142 - protein, 40 aa, Artificial Sequence
  Description of Artificial Sequence: Synthetic polypeptide
MNHLLNYVWPNVFETSPHVIQAVMGALEGLRVAIGPCRML

SEQ ID NO: 9143 - protein, 40 aa, Artificial Sequence
  Description of Artificial Sequence: Synthetic polypeptide
VWPNVFETSPHVIQAVMGALEGLRVAIGPCRMLQYCLQGL

SEQ ID NO: 9144 - protein, 40 aa, Artificial Sequence
  Description of Artificial Sequence: Synthetic polypeptide
WPNVFETSPHVIQAVMGALEGLRVAIGPCRMLQYCLQGLF

SEQ ID NO: 9145 - protein, 40 aa, Artificial Sequence
  Description of Artificial Sequence: Synthetic polypeptide
PNVFETSPHVIQAVMGALEGLRVAIGPCRMLQYCLQGLFH

SEQ ID NO: 9146 - protein, 40 aa, Artificial Sequence
  Description of Artificial Sequence: Synthetic polypeptide
HVIQAVMGALEGLRVAIGPCRMLQYCLQGLFHPARKVRDV

SEQ ID NO: 9147 - protein, 40 aa, Artificial Sequence
  Description of Artificial Sequence: Synthetic polypeptide
MQYCLQGLFHPARKVRDVYWKIYNSIYIGSQDALIAHYPR

SEQ ID NO: 9148 - protein, 40 aa, Artificial Sequence
  Description of Artificial Sequence: Synthetic polypeptide
QYCLQGLFHPARKVRDVYWKIYNSIYIGSQDALIAHYPRI

SEQ ID NO: 9149 - protein, 40 aa, Artificial Sequence
  Description of Artificial Sequence: Synthetic polypeptide
PKLNRENFPGVSWDSLPDELLLGIFSCLCLPELLKVSGVC

SEQ ID NO: 9150 - protein, 40 aa, Artificial Sequence
  Description of Artificial Sequence: Synthetic polypeptide
KLNRENFPGVSWDSLPDELLLGIFSCLCLPELLKVSGVCK

SEQ ID NO: 9151 - protein, 40 aa, Artificial Sequence
  Description of Artificial Sequence: Synthetic polypeptide
RENFPGVSWDSLPDELLLGIFSCLCLPELLKVSGVCKRWY

SEQ ID NO: 9152 - protein, 40 aa, Artificial Sequence
  Description of Artificial Sequence: Synthetic polypeptide
FPGVSWDSLPDELLLGIFSCLCLPELLKVSGVCKRWYRLA

SEQ ID NO: 9153 - protein, 40 aa, Artificial Sequence
  Description of Artificial Sequence: Synthetic polypeptide
VSWDSLPDELLLGIFSCLCLPELLKVSGVCKRWYRLASDE

SEQ ID NO: 9154 - protein, 40 aa, Artificial Sequence
  Description of Artificial Sequence: Synthetic polypeptide
SWDSLPDELLLGIFSCLCLPELLKVSGVCKRWYRLASDES

SEQ ID NO: 9155 - protein, 40 aa, Artificial Sequence
  Description of Artificial Sequence: Synthetic polypeptide
MGIFSCLCLPELLKVSGVCKRWYRLASDESLWQTLDLTGK

SEQ ID NO: 9156 - protein, 40 aa, Artificial Sequence
  Description of Artificial Sequence: Synthetic polypeptide
GIFSCLCLPELLKVSGVCKRWYRLASDESLWQTLDLTGKN

SEQ ID NO: 9157 - protein, 40 aa, Artificial Sequence
  Description of Artificial Sequence: Synthetic polypeptide
FSCLCLPELLKVSGVCKRWYRLASDESLWQTLDLTGKNLH

SEQ ID NO: 9158 - protein, 40 aa, Artificial Sequence
  Description of Artificial Sequence: Synthetic polypeptide
VCKRWYRLASDESLWQTLDLTGKNLHPDVTGRLLSQGVIA

SEQ ID NO: 9159 - protein, 40 aa, Artificial Sequence
  Description of Artificial Sequence: Synthetic polypeptide
KRWYRLASDESLWQTLDLTGKNLHPDVTGRLLSQGVIAFR

SEQ ID NO: 9160 - protein, 40 aa, Artificial Sequence
  Description of Artificial Sequence: Synthetic polypeptide
RWYRLASDESLWQTLDLTGKNLHPDVTGRLLSQGVIAFRC

SEQ ID NO: 9161 - protein, 40 aa, Artificial Sequence
  Description of Artificial Sequence: Synthetic polypeptide
ASDESLWQTLDLTGKNLHPDVTGRLLSQGVIAFRCPRSFM

SEQ ID NO: 9162 - protein, 40 aa, Artificial Sequence
  Description of Artificial Sequence: Synthetic polypeptide
MSQGVIAFRCPRSFMDQPLAEHFSPFRVQHMDLSNSVIEV

SEQ ID NO: 9163 - protein, 40 aa, Artificial Sequence
  Description of Artificial Sequence: Synthetic polypeptide
CSKLQNLSLEGLRLSDPIVNTLAKNSNLVRLNLSGCSGFS

SEQ ID NO: 9164 - protein, 40 aa, Artificial Sequence
  Description of Artificial Sequence: Synthetic polypeptide
SKLQNLSLEGLRLSDPIVNTLAKNSNLVRLNLSGCSGFSE

SEQ ID NO: 9165 - protein, 40 aa, Artificial Sequence
  Description of Artificial Sequence: Synthetic polypeptide
KLQNLSLEGLRLSDPIVNTLAKNSNLVRLNLSGCSGFSEF

SEQ ID NO: 9166 - protein, 40 aa, Artificial Sequence
  Description of Artificial Sequence: Synthetic polypeptide
QNLSLEGLRLSDPIVNTLAKNSNLVRLNLSGCSGFSEFAL

SEQ ID NO: 9167 - protein, 40 aa, Artificial Sequence
  Description of Artificial Sequence: Synthetic polypeptide
NLSLEGLRLSDPIVNTLAKNSNLVRLNLSGCSGFSEFALQ

SEQ ID NO: 9168 - protein, 40 aa, Artificial Sequence
  Description of Artificial Sequence: Synthetic polypeptide
LSLEGLRLSDPIVNTLAKNSNLVRLNLSGCSGFSEFALQT

SEQ ID NO: 9169 - protein, 40 aa, Artificial Sequence
  Description of Artificial Sequence: Synthetic polypeptide
SLEGLRLSDPIVNTLAKNSNLVRLNLSGCSGFSEFALQTL

SEQ ID NO: 9170 - protein, 40 aa, Artificial Sequence
  Description of Artificial Sequence: Synthetic polypeptide
MEGLRLSDPIVNTLAKNSNLVRLNLSGCSGFSEFALQTLL

SEQ ID NO: 9171 - protein, 40 aa, Artificial Sequence
  Description of Artificial Sequence: Synthetic polypeptide
EGLRLSDPIVNTLAKNSNLVRLNLSGCSGFSEFALQTLLS

SEQ ID NO: 9172 - protein, 40 aa, Artificial Sequence
  Description of Artificial Sequence: Synthetic polypeptide
LSDPIVNTLAKNSNLVRLNLSGCSGFSEFALQTLLSSCSR

SEQ ID NO: 9173 - protein, 40 aa, Artificial Sequence
  Description of Artificial Sequence: Synthetic polypeptide
PIVNTLAKNSNLVRLNLSGCSGFSEFALQTLLSSCSRLDE

SEQ ID NO: 9174 - protein, 40 aa, Artificial Sequence
  Description of Artificial Sequence: Synthetic polypeptide
KNSNLVRLNLSGCSGFSEFALQTLLSSCSRLDELNLSWCF

SEQ ID NO: 9175 - protein, 40 aa, Artificial Sequence
  Description of Artificial Sequence: Synthetic polypeptide
SNLVRLNLSGCSGFSEFALQTLLSSCSRLDELNLSWCFDF

SEQ ID NO: 9176 - protein, 40 aa, Artificial Sequence
  Description of Artificial Sequence: Synthetic polypeptide
SWCFDFTEKHVQVAVAHVSETITQLNLSGYRKNLQKSDLS

SEQ ID NO: 9177 - protein, 40 aa, Artificial Sequence
  Description of Artificial Sequence: Synthetic polypeptide
WCFDFTEKHVQVAVAHVSETITQLNLSGYRKNLQKSDLST

SEQ ID NO: 9178 - protein, 40 aa, Artificial Sequence
  Description of Artificial Sequence: Synthetic polypeptide
QKSDLSTLVRRCPNLVHLDLSDSVMLKNDCFQEFFQLNYL

SEQ ID NO: 9179 - protein, 40 aa, Artificial Sequence
  Description of Artificial Sequence: Synthetic polypeptide
MLKNDCFQEFFQLNYLQHLSLSRCYDIIPETLLELGEIPT

SEQ ID NO: 9180 - protein, 40 aa, Artificial Sequence
  Description of Artificial Sequence: Synthetic polypeptide
RCYDIIPETLLELGEIPTLKTLQVFGIVPDGTLQLLKEAL

SEQ ID NO: 9181 - protein, 40 aa, Artificial Sequence
  Description of Artificial Sequence: Synthetic polypeptide
YDIIPETLLELGEIPTLKTLQVFGIVPDGTLQLLKEALPH

SEQ ID NO: 9182 - protein, 40 aa, Artificial Sequence
  Description of Artificial Sequence: Synthetic polypeptide
DIIPETLLELGEIPTLKTLQVFGIVPDGTLQLLKEALPHL

SEQ ID NO: 9183 - protein, 40 aa, Artificial Sequence
  Description of Artificial Sequence: Synthetic polypeptide
GEQNGQEEKWCEKAVKSLVKKLKKTGRLDELEKAITTQNC

SEQ ID NO: 9184 - protein, 40 aa, Artificial Sequence
  Description of Artificial Sequence: Synthetic polypeptide
NGQEEKWCEKAVKSLVKKLKKTGRLDELEKAITTQNCNTK

SEQ ID NO: 9185 - protein, 40 aa, Artificial Sequence
  Description of Artificial Sequence: Synthetic polypeptide
AVKSLVKKLKKTGRLDELEKAITTQNCNTKCVTIPSTCSE

SEQ ID NO: 9186 - protein, 40 aa, Artificial Sequence
  Description of Artificial Sequence: Synthetic polypeptide
KAITTQNCNTKCVTIPSTCSEIWGLSTPNTIDQWDTTGLY

SEQ ID NO: 9187 - protein, 40 aa, Artificial Sequence
  Description of Artificial Sequence: Synthetic polypeptide
ITTQNCNTKCVTIPSTCSEIWGLSTPNTIDQWDTTGLYSF

SEQ ID NO: 9188 - protein, 40 aa, Artificial Sequence
  Description of Artificial Sequence: Synthetic polypeptide
CNTKCVTIPSTCSEIWGLSTPNTIDQWDTTGLYSFSEQTR

SEQ ID NO: 9189 - protein, 40 aa, Artificial Sequence
  Description of Artificial Sequence: Synthetic polypeptide
TKCVTIPSTCSEIWGLSTPNTIDQWDTTGLYSFSEQTRSL

SEQ ID NO: 9190 - protein, 40 aa, Artificial Sequence
  Description of Artificial Sequence: Synthetic polypeptide
KCVTIPSTCSEIWGLSTPNTIDQWDTTGLYSFSEQTRSLD

SEQ ID NO: 9191 - protein, 40 aa, Artificial Sequence
  Description of Artificial Sequence: Synthetic polypeptide
VTIPSTCSEIWGLSTPNTIDQWDTTGLYSFSEQTRSLDGR

SEQ ID NO: 9192 - protein, 40 aa, Artificial Sequence
  Description of Artificial Sequence: Synthetic polypeptide
IPSTCSEIWGLSTPNTIDQWDTTGLYSFSEQTRSLDGRLQ

SEQ ID NO: 9193 - protein, 40 aa, Artificial Sequence
  Description of Artificial Sequence: Synthetic polypeptide
PSTCSEIWGLSTPNTIDQWDTTGLYSFSEQTRSLDGRLQV

SEQ ID NO: 9194 - protein, 40 aa, Artificial Sequence
  Description of Artificial Sequence: Synthetic polypeptide
STCSEIWGLSTPNTIDQWDTTGLYSFSEQTRSLDGRLQVS

SEQ ID NO: 9195 - protein, 40 aa, Artificial Sequence
  Description of Artificial Sequence: Synthetic polypeptide
TCSEIWGLSTPNTIDQWDTTGLYSFSEQTRSLDGRLQVSH

SEQ ID NO: 9196 - protein, 40 aa, Artificial Sequence
  Description of Artificial Sequence: Synthetic polypeptide
CSEIWGLSTPNTIDQWDTTGLYSFSEQTRSLDGRLQVSHR

SEQ ID NO: 9197 - protein, 40 aa, Artificial Sequence
  Description of Artificial Sequence: Synthetic polypeptide
IDQWDTTGLYSFSEQTRSLDGRLQVSHRKGLPHVIYCRLW

SEQ ID NO: 9198 - protein, 40 aa, Artificial Sequence
  Description of Artificial Sequence: Synthetic polypeptide
QWDTTGLYSFSEQTRSLDGRLQVSHRKGLPHVIYCRLWRW

SEQ ID NO: 9199 - protein, 40 aa, Artificial Sequence
  Description of Artificial Sequence: Synthetic polypeptide
TTGLYSFSEQTRSLDGRLQVSHRKGLPHVIYCRLWRWPDL

SEQ ID NO: 9200 - protein, 40 aa, Artificial Sequence
  Description of Artificial Sequence: Synthetic polypeptide
GLYSFSEQTRSLDGRLQVSHRKGLPHVIYCRLWRWPDLHS

SEQ ID NO: 9201 - protein, 40 aa, Artificial Sequence
  Description of Artificial Sequence: Synthetic polypeptide
AIENCEYAFNLKKDEVCVNPYHYQRVETPVLPPVLVPRHT

SEQ ID NO: 9202 - protein, 40 aa, Artificial Sequence
  Description of Artificial Sequence: Synthetic polypeptide
NCEYAFNLKKDEVCVNPYHYQRVETPVLPPVLVPRHTEIL

SEQ ID NO: 9203 - protein, 40 aa, Artificial Sequence
  Description of Artificial Sequence: Synthetic polypeptide
RHTEILTELPPLDDYTHSIPENTNFPAGIEPQSNYIPETP

SEQ ID NO: 9204 - protein, 40 aa, Artificial Sequence
  Description of Artificial Sequence: Synthetic polypeptide
TEILTELPPLDDYTHSIPENTNFPAGIEPQSNYIPETPPP

SEQ ID NO: 9205 - protein, 40 aa, Artificial Sequence
  Description of Artificial Sequence: Synthetic polypeptide
PGYISEDGETSDQQLNQSMDTGSPAELSPTTLSPVNHSLD

SEQ ID NO: 9206 - protein, 40 aa, Artificial Sequence
  Description of Artificial Sequence: Synthetic polypeptide
EDGETSDQQLNQSMDTGSPAELSPTTLSPVNHSLDLQPVT

SEQ ID NO: 9207 - protein, 40 aa, Artificial Sequence
  Description of Artificial Sequence: Synthetic polypeptide
AELSPTTLSPVNHSLDLQPVTYSEPAFWCSIAYYELNQRV

SEQ ID NO: 9208 - protein, 40 aa, Artificial Sequence
  Description of Artificial Sequence: Synthetic polypeptide
TTLSPVNHSLDLQPVTYSEPAFWCSIAYYELNQRVGETFH

SEQ ID NO: 9209 - protein, 40 aa, Artificial Sequence
  Description of Artificial Sequence: Synthetic polypeptide
ASQPSLTVDGFTDPSNSERFCLGLLSNVNRNATVEMTRRH

SEQ ID NO: 9210 - protein, 40 aa, Artificial Sequence
  Description of Artificial Sequence: Synthetic polypeptide
TDPSNSERFCLGLLSNVNRNATVEMTRRHIGRGVRLYYIG

SEQ ID NO: 9211 - protein, 40 aa, Artificial Sequence
  Description of Artificial Sequence: Synthetic polypeptide
DPSNSERFCLGLLSNVNRNATVEMTRRHIGRGVRLYYIGG

SEQ ID NO: 9212 - protein, 40 aa, Artificial Sequence
  Description of Artificial Sequence: Synthetic polypeptide
SNSERFCLGLLSNVNRNATVEMTRRHIGRGVRLYYIGGEV

SEQ ID NO: 9213 - protein, 40 aa, Artificial Sequence
  Description of Artificial Sequence: Synthetic polypeptide
SERFCLGLLSNVNRNATVEMTRRHIGRGVRLYYIGGEVFA

SEQ ID NO: 9214 - protein, 40 aa, Artificial Sequence
  Description of Artificial Sequence: Synthetic polypeptide
ERFCLGLLSNVNRNATVEMTRRHIGRGVRLYYIGGEVFAE

SEQ ID NO: 9215 - protein, 40 aa, Artificial Sequence
  Description of Artificial Sequence: Synthetic polypeptide
GLLSNVNRNATVEMTRRHIGRGVRLYYIGGEVFAECLSDS

SEQ ID NO: 9216 - protein, 40 aa, Artificial Sequence
  Description of Artificial Sequence: Synthetic polypeptide
SNVNRNATVEMTRRHIGRGVRLYYIGGEVFAECLSDSAIF

SEQ ID NO: 9217 - protein, 40 aa, Artificial Sequence
  Description of Artificial Sequence: Synthetic polypeptide
NRNATVEMTRRHIGRGVRLYYIGGEVFAECLSDSAIFVQS

SEQ ID NO: 9218 - protein, 40 aa, Artificial Sequence
  Description of Artificial Sequence: Synthetic polypeptide
RNATVEMTRRHIGRGVRLYYIGGEVFAECLSDSAIFVQSP

SEQ ID NO: 9219 - protein, 40 aa, Artificial Sequence
  Description of Artificial Sequence: Synthetic polypeptide
TVEMTRRHIGRGVRLYYIGGEVFAECLSDSAIFVQSPNCN

SEQ ID NO: 9220 - protein, 40 aa, Artificial Sequence
  Description of Artificial Sequence: Synthetic polypeptide
VEMTRRHIGRGVRLYYIGGEVFAECLSDSAIFVQSPNCNQ

SEQ ID NO: 9221 - protein, 40 aa, Artificial Sequence
  Description of Artificial Sequence: Synthetic polypeptide
HIGRGVRLYYIGGEVFAECLSDSAIFVQSPNCNQRYGWHP

SEQ ID NO: 9222 - protein, 40 aa, Artificial Sequence
  Description of Artificial Sequence: Synthetic polypeptide
LYYIGGEVFAECLSDSAIFVQSPNCNQRYGWHPATVCKIP

SEQ ID NO: 9223 - protein, 40 aa, Artificial Sequence
  Description of Artificial Sequence: Synthetic polypeptide
CKIPPGCNLKIFNNQEFAALLAQSVNQGFEAVYQLTRMCT

SEQ ID NO: 9224 - protein, 40 aa, Artificial Sequence
  Description of Artificial Sequence: Synthetic polypeptide
PGCNLKIFNNQEFAALLAQSVNQGFEAVYQLTRMCTIRMS

SEQ ID NO: 9225 - protein, 40 aa, Artificial Sequence
  Description of Artificial Sequence: Synthetic polypeptide
FNNQEFAALLAQSVNQGFEAVYQLTRMCTIRMSFVKGWGA

SEQ ID NO: 9226 - protein, 40 aa, Artificial Sequence
  Description of Artificial Sequence: Synthetic polypeptide
AALLAQSVNQGFEAVYQLTRMCTIRMSFVKGWGAEYRRQT

SEQ ID NO: 9227 - protein, 40 aa, Artificial Sequence
  Description of Artificial Sequence: Synthetic polypeptide
TRMCTIRMSFVKGWGAEYRRQTVTSTPCWIELHLNGPLQW

SEQ ID NO: 9228 - protein, 40 aa, Artificial Sequence
  Description of Artificial Sequence: Synthetic polypeptide
MSFVKGWGAEYRRQTVTSTPCWIELHLNGPLQWLDKVLTQ

SEQ ID NO: 9229 - protein, 40 aa, Artificial Sequence
  Description of Artificial Sequence: Synthetic polypeptide
SITNTPTSNDACLSIVHSLMCHRQGGESETFAKRAIESLV

SEQ ID NO: 9230 - protein, 40 aa, Artificial Sequence
  Description of Artificial Sequence: Synthetic polypeptide
CLSIVHSLMCHRQGGESETFAKRAIESLVKKLKEKKDELD

SEQ ID NO: 9231 - protein, 40 aa, Artificial Sequence
  Description of Artificial Sequence: Synthetic polypeptide
IVHSLMCHRQGGESETFAKRAIESLVKKLKEKKDELDSLI

SEQ ID NO: 9232 - protein, 40 aa, Artificial Sequence
  Description of Artificial Sequence: Synthetic polypeptide
MCHRQGGESETFAKRAIESLVKKLKEKKDELDSLITAITT

SEQ ID NO: 9233 - protein, 40 aa, Artificial Sequence
  Description of Artificial Sequence: Synthetic polypeptide
CHRQGGESETFAKRAIESLVKKLKEKKDELDSLITAITTN

SEQ ID NO: 9234 - protein, 40 aa, Artificial Sequence
  Description of Artificial Sequence: Synthetic polypeptide
GESETFAKRAIESLVKKLKEKKDELDSLITAITTNGAHPS

SEQ ID NO: 9235 - protein, 40 aa, Artificial Sequence
  Description of Artificial Sequence: Synthetic polypeptide
ESETFAKRAIESLVKKLKEKKDELDSLITAITTNGAHPSK

SEQ ID NO: 9236 - protein, 40 aa, Artificial Sequence
  Description of Artificial Sequence: Synthetic polypeptide
SETFAKRAIESLVKKLKEKKDELDSLITAITTNGAHPSKC

SEQ ID NO: 9237 - protein, 40 aa, Artificial Sequence
  Description of Artificial Sequence: Synthetic polypeptide
AKRAIESLVKKLKEKKDELDSLITAITTNGAHPSKCVTIQ

SEQ ID NO: 9238 - protein, 40 aa, Artificial Sequence
  Description of Artificial Sequence: Synthetic polypeptide
KRAIESLVKKLKEKKDELDSLITAITTNGAHPSKCVTIQR

SEQ ID NO: 9239 - protein, 40 aa, Artificial Sequence
  Description of Artificial Sequence: Synthetic polypeptide
AIESLVKKLKEKKDELDSLITAITTNGAHPSKCVTIQRTL

SEQ ID NO: 9240 - protein, 40 aa, Artificial Sequence
  Description of Artificial Sequence: Synthetic polypeptide
TLDGRLQVAGRKGFPHVIYARLWRWPDLHKNELKHVKYCQ

SEQ ID NO: 9241 - protein, 40 aa, Artificial Sequence
  Description of Artificial Sequence: Synthetic polypeptide
VAGRKGFPHVIYARLWRWPDLHKNELKHVKYCQYAFDLKC

SEQ ID NO: 9242 - protein, 40 aa, Artificial Sequence
  Description of Artificial Sequence: Synthetic polypeptide
FPHVIYARLWRWPDLHKNELKHVKYCQYAFDLKCDSVCVN

SEQ ID NO: 9243 - protein, 40 aa, Artificial Sequence
  Description of Artificial Sequence: Synthetic polypeptide
IYARLWRWPDLHKNELKHVKYCQYAFDLKCDSVCVNPYHY

SEQ ID NO: 9244 - protein, 40 aa, Artificial Sequence
  Description of Artificial Sequence: Synthetic polypeptide
WRWPDLHKNELKHVKYCQYAFDLKCDSVCVNPYHYERVVS

SEQ ID NO: 9245 - protein, 40 aa, Artificial Sequence
  Description of Artificial Sequence: Synthetic polypeptide
WPDLHKNELKHVKYCQYAFDLKCDSVCVNPYHYERVVSPG

SEQ ID NO: 9246 - protein, 40 aa, Artificial Sequence
  Description of Artificial Sequence: Synthetic polypeptide
PDLHKNELKHVKYCQYAFDLKCDSVCVNPYHYERVVSPGI

SEQ ID NO: 9247 - protein, 40 aa, Artificial Sequence
  Description of Artificial Sequence: Synthetic polypeptide
LHKNELKHVKYCQYAFDLKCDSVCVNPYHYERVVSPGIDL

SEQ ID NO: 9248 - protein, 40 aa, Artificial Sequence
  Description of Artificial Sequence: Synthetic polypeptide
VKYCQYAFDLKCDSVCVNPYHYERVVSPGIDLSGLTLQSN

SEQ ID NO: 9249 - protein, 40 aa, Artificial Sequence
  Description of Artificial Sequence: Synthetic polypeptide
YCQYAFDLKCDSVCVNPYHYERVVSPGIDLSGLTLQSNAP

SEQ ID NO: 9250 - protein, 40 aa, Artificial Sequence
  Description of Artificial Sequence: Synthetic polypeptide
CQYAFDLKCDSVCVNPYHYERVVSPGIDLSGLTLQSNAPS

SEQ ID NO: 9251 - protein, 40 aa, Artificial Sequence
  Description of Artificial Sequence: Synthetic polypeptide
SPGIDLSGLTLQSNAPSSMMVKDEYVHDFEGQPSLSTEGH

SEQ ID NO: 9252 - protein, 40 aa, Artificial Sequence
  Description of Artificial Sequence: Synthetic polypeptide
IDLSGLTLQSNAPSSMMVKDEYVHDFEGQPSLSTEGHSIQ

SEQ ID NO: 9253 - protein, 40 aa, Artificial Sequence
  Description of Artificial Sequence: Synthetic polypeptide
SLSTEGHSIQTIQHPPSNRASTETYSTPALLAPSESNATS

SEQ ID NO: 9254 - protein, 40 aa, Artificial Sequence
  Description of Artificial Sequence: Synthetic polypeptide
PVASTSQPASILGGSHSEGLLQIASGPQPGQQQNGFTGQP

SEQ ID NO: 9255 - protein, 40 aa, Artificial Sequence
  Description of Artificial Sequence: Synthetic polypeptide
PGHYWPVHNELAFQPPISNHPAPEYWCSIAYFEMDVQVGE

SEQ ID NO: 9256 - protein, 40 aa, Artificial Sequence
  Description of Artificial Sequence: Synthetic polypeptide
YWPVHNELAFQPPISNHPAPEYWCSIAYFEMDVQVGETFK

SEQ ID NO: 9257 - protein, 40 aa, Artificial Sequence
  Description of Artificial Sequence: Synthetic polypeptide
ISNHPAPEYWCSIAYFEMDVQVGETFKVPSSCPIVTVDGY

SEQ ID NO: 9258 - protein, 40 aa, Artificial Sequence
  Description of Artificial Sequence: Synthetic polypeptide
NHPAPEYWCSIAYFEMDVQVGETFKVPSSCPIVTVDGYVD

SEQ ID NO: 9259 - protein, 40 aa, Artificial Sequence
  Description of Artificial Sequence: Synthetic polypeptide
HPAPEYWCSIAYFEMDVQVGETFKVPSSCPIVTVDGYVDP

SEQ ID NO: 9260 - protein, 40 aa, Artificial Sequence
  Description of Artificial Sequence: Synthetic polypeptide
PEYWCSIAYFEMDVQVGETFKVPSSCPIVTVDGYVDPSGG

SEQ ID NO: 9261 - protein, 40 aa, Artificial Sequence
  Description of Artificial Sequence: Synthetic polypeptide
EYWCSIAYFEMDVQVGETFKVPSSCPIVTVDGYVDPSGGD

SEQ ID NO: 9262 - protein, 40 aa, Artificial Sequence
  Description of Artificial Sequence: Synthetic polypeptide
YWCSIAYFEMDVQVGETFKVPSSCPIVTVDGYVDPSGGDR

SEQ ID NO: 9263 - protein, 40 aa, Artificial Sequence
  Description of Artificial Sequence: Synthetic polypeptide
CSIAYFEMDVQVGETFKVPSSCPIVTVDGYVDPSGGDRFC

SEQ ID NO: 9264 - protein, 40 aa, Artificial Sequence
  Description of Artificial Sequence: Synthetic polypeptide
YFEMDVQVGETFKVPSSCPIVTVDGYVDPSGGDRFCLGQL

SEQ ID NO: 9265 - protein, 40 aa, Artificial Sequence
  Description of Artificial Sequence: Synthetic polypeptide
EMDVQVGETFKVPSSCPIVTVDGYVDPSGGDRFCLGQLSN

SEQ ID NO: 9266 - protein, 40 aa, Artificial Sequence
  Description of Artificial Sequence: Synthetic polypeptide
SGGDRFCLGQLSNVHRTEAIERARLHIGKGVQLECKGEGD

SEQ ID NO: 9267 - protein, 40 aa, Artificial Sequence
  Description of Artificial Sequence: Synthetic polypeptide
TEAIERARLHIGKGVQLECKGEGDVWVRCLSDHAVFVQSY

SEQ ID NO: 9268 - protein, 40 aa, Artificial Sequence
  Description of Artificial Sequence: Synthetic polypeptide
EAIERARLHIGKGVQLECKGEGDVWVRCLSDHAVFVQSYY

SEQ ID NO: 9269 - protein, 40 aa, Artificial Sequence
  Description of Artificial Sequence: Synthetic polypeptide
IERARLHIGKGVQLECKGEGDVWVRCLSDHAVFVQSYYLD

SEQ ID NO: 9270 - protein, 40 aa, Artificial Sequence
  Description of Artificial Sequence: Synthetic polypeptide
ERARLHIGKGVQLECKGEGDVWVRCLSDHAVFVQSYYLDR

SEQ ID NO: 9271 - protein, 40 aa, Artificial Sequence
  Description of Artificial Sequence: Synthetic polypeptide
IGKGVQLECKGEGDVWVRCLSDHAVFVQSYYLDREAGRAP

SEQ ID NO: 9272 - protein, 40 aa, Artificial Sequence
  Description of Artificial Sequence: Synthetic polypeptide
ECKGEGDVWVRCLSDHAVFVQSYYLDREAGRAPGDAVHKI

SEQ ID NO: 9273 - protein, 40 aa, Artificial Sequence
  Description of Artificial Sequence: Synthetic polypeptide
LSDHAVFVQSYYLDREAGRAPGDAVHKIYPSAYIKVFDLR

SEQ ID NO: 9274 - protein, 40 aa, Artificial Sequence
  Description of Artificial Sequence: Synthetic polypeptide
DHAVFVQSYYLDREAGRAPGDAVHKIYPSAYIKVFDLRQC

SEQ ID NO: 9275 - protein, 40 aa, Artificial Sequence
  Description of Artificial Sequence: Synthetic polypeptide
HAVFVQSYYLDREAGRAPGDAVHKIYPSAYIKVFDLRQCH

SEQ ID NO: 9276 - protein, 40 aa, Artificial Sequence
  Description of Artificial Sequence: Synthetic polypeptide
FVQSYYLDREAGRAPGDAVHKIYPSAYIKVFDLRQCHRQM

SEQ ID NO: 9277 - protein, 40 aa, Artificial Sequence
  Description of Artificial Sequence: Synthetic polypeptide
VQSYYLDREAGRAPGDAVHKIYPSAYIKVFDLRQCHRQMQ

SEQ ID NO: 9278 - protein, 40 aa, Artificial Sequence
  Description of Artificial Sequence: Synthetic polypeptide
LDREAGRAPGDAVHKIYPSAYIKVFDLRQCHRQMQQQAAT

SEQ ID NO: 9279 - protein, 40 aa, Artificial Sequence
  Description of Artificial Sequence: Synthetic polypeptide
RAPGDAVHKIYPSAYIKVFDLRQCHRQMQQQAATAQAAAA

SEQ ID NO: 9280 - protein, 40 aa, Artificial Sequence
  Description of Artificial Sequence: Synthetic polypeptide
GDAVHKIYPSAYIKVFDLRQCHRQMQQQAATAQAAAAAQA

SEQ ID NO: 9281 - protein, 40 aa, Artificial Sequence
  Description of Artificial Sequence: Synthetic polypeptide
DAVHKIYPSAYIKVFDLRQCHRQMQQQAATAQAAAAAQAA

SEQ ID NO: 9282 - protein, 40 aa, Artificial Sequence
  Description of Artificial Sequence: Synthetic polypeptide
AVHKIYPSAYIKVFDLRQCHRQMQQQAATAQAAAAAQAAA

SEQ ID NO: 9283 - protein, 40 aa, Artificial Sequence
  Description of Artificial Sequence: Synthetic polypeptide
VHKIYPSAYIKVFDLRQCHRQMQQQAATAQAAAAAQAAAV

SEQ ID NO: 9284 - protein, 40 aa, Artificial Sequence
  Description of Artificial Sequence: Synthetic polypeptide
HKIYPSAYIKVFDLRQCHRQMQQQAATAQAAAAAQAAAVA

SEQ ID NO: 9285 - protein, 40 aa, Artificial Sequence
  Description of Artificial Sequence: Synthetic polypeptide
MQQQAATAQAAAAAQAAAVAGNIPGPGSVGGIAPAISLSA

SEQ ID NO: 9286 - protein, 40 aa, Artificial Sequence
  Description of Artificial Sequence: Synthetic polypeptide
AVAGNIPGPGSVGGIAPAISLSAAAGIGVDDLRRLCILRM

SEQ ID NO: 9287 - protein, 40 aa, Artificial Sequence
  Description of Artificial Sequence: Synthetic polypeptide
SVGGIAPAISLSAAAGIGVDDLRRLCILRMSFVKGWGPDY

SEQ ID NO: 9288 - protein, 40 aa, Artificial Sequence
  Description of Artificial Sequence: Synthetic polypeptide
GIGVDDLRRLCILRMSFVKGWGPDYPRQSIKETPCWIEIH

SEQ ID NO: 9289 - protein, 40 aa, Artificial Sequence
  Description of Artificial Sequence: Synthetic polypeptide
PRAPRCRAVRSLLRSHYREVLPLATFVRRLGPQGWRLVQR

SEQ ID NO: 9290 - protein, 40 aa, Artificial Sequence
  Description of Artificial Sequence: Synthetic polypeptide
PRCRAVRSLLRSHYREVLPLATFVRRLGPQGWRLVQRGDP

SEQ ID NO: 9291 - protein, 40 aa, Artificial Sequence
  Description of Artificial Sequence: Synthetic polypeptide
CRAVRSLLRSHYREVLPLATFVRRLGPQGWRLVQRGDPAA

SEQ ID NO: 9292 - protein, 40 aa, Artificial Sequence
  Description of Artificial Sequence: Synthetic polypeptide
RSLLRSHYREVLPLATFVRRLGPQGWRLVQRGDPAAFRAL

SEQ ID NO: 9293 - protein, 40 aa, Artificial Sequence
  Description of Artificial Sequence: Synthetic polypeptide
SLLRSHYREVLPLATFVRRLGPQGWRLVQRGDPAAFRALV

SEQ ID NO: 9294 - protein, 40 aa, Artificial Sequence
  Description of Artificial Sequence: Synthetic polypeptide
MLRSHYREVLPLATFVRRLGPQGWRLVQRGDPAAFRALVA

SEQ ID NO: 9295 - protein, 40 aa, Artificial Sequence
  Description of Artificial Sequence: Synthetic polypeptide
MRSHYREVLPLATFVRRLGPQGWRLVQRGDPAAFRALVAQ

SEQ ID NO: 9296 - protein, 40 aa, Artificial Sequence
  Description of Artificial Sequence: Synthetic polypeptide
RSHYREVLPLATFVRRLGPQGWRLVQRGDPAAFRALVAQC

SEQ ID NO: 9297 - protein, 40 aa, Artificial Sequence
  Description of Artificial Sequence: Synthetic polypeptide
SHYREVLPLATFVRRLGPQGWRLVQRGDPAAFRALVAQCL

SEQ ID NO: 9298 - protein, 40 aa, Artificial Sequence
  Description of Artificial Sequence: Synthetic polypeptide
HYREVLPLATFVRRLGPQGWRLVQRGDPAAFRALVAQCLV

SEQ ID NO: 9299 - protein, 40 aa, Artificial Sequence
  Description of Artificial Sequence: Synthetic polypeptide
EVLPLATFVRRLGPQGWRLVQRGDPAAFRALVAQCLVCVP

SEQ ID NO: 9300 - protein, 40 aa, Artificial Sequence
  Description of Artificial Sequence: Synthetic polypeptide
VLPLATFVRRLGPQGWRLVQRGDPAAFRALVAQCLVCVPW

SEQ ID NO: 9301 - protein, 40 aa, Artificial Sequence
  Description of Artificial Sequence: Synthetic polypeptide
MPLATFVRRLGPQGWRLVQRGDPAAFRALVAQCLVCVPWD

SEQ ID NO: 9302 - protein, 40 aa, Artificial Sequence
  Description of Artificial Sequence: Synthetic polypeptide
PLATFVRRLGPQGWRLVQRGDPAAFRALVAQCLVCVPWDA

SEQ ID NO: 9303 - protein, 40 aa, Artificial Sequence
  Description of Artificial Sequence: Synthetic polypeptide
MATFVRRLGPQGWRLVQRGDPAAFRALVAQCLVCVPWDAR

SEQ ID NO: 9304 - protein, 40 aa, Artificial Sequence
  Description of Artificial Sequence: Synthetic polypeptide
ATFVRRLGPQGWRLVQRGDPAAFRALVAQCLVCVPWDARP

SEQ ID NO: 9305 - protein, 40 aa, Artificial Sequence
  Description of Artificial Sequence: Synthetic polypeptide
FVRRLGPQGWRLVQRGDPAAFRALVAQCLVCVPWDARPPP

SEQ ID NO: 9306 - protein, 40 aa, Artificial Sequence
  Description of Artificial Sequence: Synthetic polypeptide
VRRLGPQGWRLVQRGDPAAFRALVAQCLVCVPWDARPPPA

SEQ ID NO: 9307 - protein, 40 aa, Artificial Sequence
  Description of Artificial Sequence: Synthetic polypeptide
RRLGPQGWRLVQRGDPAAFRALVAQCLVCVPWDARPPPAA

SEQ ID NO: 9308 - protein, 40 aa, Artificial Sequence
  Description of Artificial Sequence: Synthetic polypeptide
PQGWRLVQRGDPAAFRALVAQCLVCVPWDARPPPAAPSFR

SEQ ID NO: 9309 - protein, 40 aa, Artificial Sequence
  Description of Artificial Sequence: Synthetic polypeptide
RLVQRGDPAAFRALVAQCLVCVPWDARPPPAAPSFRQVSC

SEQ ID NO: 9310 - protein, 40 aa, Artificial Sequence
  Description of Artificial Sequence: Synthetic polypeptide
RQVSCLKELVARVLQRLCERGAKNVLAFGFALLDGARGGP

SEQ ID NO: 9311 - protein, 40 aa, Artificial Sequence
  Description of Artificial Sequence: Synthetic polypeptide
QVSCLKELVARVLQRLCERGAKNVLAFGFALLDGARGGPP

SEQ ID NO: 9312 - protein, 40 aa, Artificial Sequence
  Description of Artificial Sequence: Synthetic polypeptide
CLKELVARVLQRLCERGAKNVLAFGFALLDGARGGPPEAF

SEQ ID NO: 9313 - protein, 40 aa, Artificial Sequence
  Description of Artificial Sequence: Synthetic polypeptide
MKELVARVLQRLCERGAKNVLAFGFALLDGARGGPPEAFT

SEQ ID NO: 9314 - protein, 40 aa, Artificial Sequence
  Description of Artificial Sequence: Synthetic polypeptide
KELVARVLQRLCERGAKNVLAFGFALLDGARGGPPEAFTT

SEQ ID NO: 9315 - protein, 40 aa, Artificial Sequence
  Description of Artificial Sequence: Synthetic polypeptide
ARVLQRLCERGAKNVLAFGFALLDGARGGPPEAFTTSVRS

SEQ ID NO: 9316 - protein, 40 aa, Artificial Sequence
  Description of Artificial Sequence: Synthetic polypeptide
RVLQRLCERGAKNVLAFGFALLDGARGGPPEAFTTSVRSY

SEQ ID NO: 9317 - protein, 40 aa, Artificial Sequence
  Description of Artificial Sequence: Synthetic polypeptide
MCERGAKNVLAFGFALLDGARGGPPEAFTTSVRSYLPNTV

SEQ ID NO: 9318 - protein, 40 aa, Artificial Sequence
  Description of Artificial Sequence: Synthetic polypeptide
RGAKNVLAFGFALLDGARGGPPEAFTTSVRSYLPNTVTDA

SEQ ID NO: 9319 - protein, 40 aa, Artificial Sequence
  Description of Artificial Sequence: Synthetic polypeptide
PNTVTDALRGSGAWGLLLRRVGDDVLVHLLARCALFVLVA

SEQ ID NO: 9320 - protein, 40 aa, Artificial Sequence
  Description of Artificial Sequence: Synthetic polypeptide
NTVTDALRGSGAWGLLLRRVGDDVLVHLLARCALFVLVAP

SEQ ID NO: 9321 - protein, 40 aa, Artificial Sequence
  Description of Artificial Sequence: Synthetic polypeptide
MRGSGAWGLLLRRVGDDVLVHLLARCALFVLVAPSCAYQV

SEQ ID NO: 9322 - protein, 40 aa, Artificial Sequence
  Description of Artificial Sequence: Synthetic polypeptide
RGSGAWGLLLRRVGDDVLVHLLARCALFVLVAPSCAYQVC

SEQ ID NO: 9323 - protein, 40 aa, Artificial Sequence
  Description of Artificial Sequence: Synthetic polypeptide
GSGAWGLLLRRVGDDVLVHLLARCALFVLVAPSCAYQVCG

SEQ ID NO: 9324 - protein, 40 aa, Artificial Sequence
  Description of Artificial Sequence: Synthetic polypeptide
GAWGLLLRRVGDDVLVHLLARCALFVLVAPSCAYQVCGPP

SEQ ID NO: 9325 - protein, 40 aa, Artificial Sequence
  Description of Artificial Sequence: Synthetic polypeptide
AWGLLLRRVGDDVLVHLLARCALFVLVAPSCAYQVCGPPL

SEQ ID NO: 9326 - protein, 40 aa, Artificial Sequence
  Description of Artificial Sequence: Synthetic polypeptide
WGLLLRRVGDDVLVHLLARCALFVLVAPSCAYQVCGPPLY

SEQ ID NO: 9327 - protein, 40 aa, Artificial Sequence
  Description of Artificial Sequence: Synthetic polypeptide
VGDDVLVHLLARCALFVLVAPSCAYQVCGPPLYQLGAATQ

SEQ ID NO: 9328 - protein, 40 aa, Artificial Sequence
  Description of Artificial Sequence: Synthetic polypeptide
RRRLGCERAWNHSVREAGVPLGLPAPGARRRGGSASRSLP

SEQ ID NO: 9329 - protein, 40 aa, Artificial Sequence
  Description of Artificial Sequence: Synthetic polypeptide
PLPKRPRRGAAPEPERTPVGQGSWAHPGRTRGPSDRGFCV

SEQ ID NO: 9330 - protein, 40 aa, Artificial Sequence
  Description of Artificial Sequence: Synthetic polypeptide
ERTPVGQGSWAHPGRTRGPSDRGFCVVSPARPAEEATSLE

SEQ ID NO: 9331 - protein, 40 aa, Artificial Sequence
  Description of Artificial Sequence: Synthetic polypeptide
VGQGSWAHPGRTRGPSDRGFCVVSPARPAEEATSLEGALS

SEQ ID NO: 9332 - protein, 40 aa, Artificial Sequence
  Description of Artificial Sequence: Synthetic polypeptide
GSWAHPGRTRGPSDRGFCVVSPARPAEEATSLEGALSGTR

SEQ ID NO: 9333 - protein, 40 aa, Artificial Sequence
  Description of Artificial Sequence: Synthetic polypeptide
EQLRPSFLLSSLRPSLTGARRLVETIFLGSRPWMPGTPRR

SEQ ID NO: 9334 - protein, 40 aa, Artificial Sequence
  Description of Artificial Sequence: Synthetic polypeptide
GARRLVETIFLGSRPWMPGTPRRLPRLPQRYWQMRPLFLE

SEQ ID NO: 9335 - protein, 40 aa, Artificial Sequence
  Description of Artificial Sequence: Synthetic polypeptide
DTDPRRLVQLLRQHSSPWQVYGFVRACLRRLVPPGLWGSR

SEQ ID NO: 9336 - protein, 40 aa, Artificial Sequence
  Description of Artificial Sequence: Synthetic polypeptide
RLVQLLRQHSSPWQVYGFVRACLRRLVPPGLWGSRHNERR

SEQ ID NO: 9337 - protein, 40 aa, Artificial Sequence
  Description of Artificial Sequence: Synthetic polypeptide
QLLRQHSSPWQVYGFVRACLRRLVPPGLWGSRHNERRFLR

SEQ ID NO: 9338 - protein, 40 aa, Artificial Sequence
  Description of Artificial Sequence: Synthetic polypeptide
PPGLWGSRHNERRFLRNTKKFISLGKHAKLSLQELTWKMS

SEQ ID NO: 9339 - protein, 40 aa, Artificial Sequence
  Description of Artificial Sequence: Synthetic polypeptide
WLRRSPGVGCVPAAEHRLREEILAKFLHWLMSVYVVELLR

SEQ ID NO: 9340 - protein, 40 aa, Artificial Sequence
  Description of Artificial Sequence: Synthetic polypeptide
SPGVGCVPAAEHRLREEILAKFLHWLMSVYVVELLRSFFY

SEQ ID NO: 9341 - protein, 40 aa, Artificial Sequence
  Description of Artificial Sequence: Synthetic polypeptide
GVGCVPAAEHRLREEILAKFLHWLMSVYVVELLRSFFYVT

SEQ ID NO: 9342 - protein, 40 aa, Artificial Sequence
  Description of Artificial Sequence: Synthetic polypeptide
RLREEILAKFLHWLMSVYVVELLRSFFYVTETTFQKNRLF

SEQ ID NO: 9343 - protein, 40 aa, Artificial Sequence
  Description of Artificial Sequence: Synthetic polypeptide
EEILAKFLHWLMSVYVVELLRSFFYVTETTFQKNRLFFYR

SEQ ID NO: 9344 - protein, 40 aa, Artificial Sequence
  Description of Artificial Sequence: Synthetic polypeptide
ILAKFLHWLMSVYVVELLRSFFYVTETTFQKNRLFFYRKS

SEQ ID NO: 9345 - protein, 40 aa, Artificial Sequence
  Description of Artificial Sequence: Synthetic polypeptide
MMSVYVVELLRSFFYVTETTFQKNRLFFYRKSVWSKLQSI

SEQ ID NO: 9346 - protein, 40 aa, Artificial Sequence
  Description of Artificial Sequence: Synthetic polypeptide
SVYVVELLRSFFYVTETTFQKNRLFFYRKSVWSKLQSIGI

SEQ ID NO: 9347 - protein, 40 aa, Artificial Sequence
  Description of Artificial Sequence: Synthetic polypeptide
VYVVELLRSFFYVTETTFQKNRLFFYRKSVWSKLQSIGIR

SEQ ID NO: 9348 - protein, 40 aa, Artificial Sequence
  Description of Artificial Sequence: Synthetic polypeptide
YVVELLRSFFYVTETTFQKNRLFFYRKSVWSKLQSIGIRQ

SEQ ID NO: 9349 - protein, 40 aa, Artificial Sequence
  Description of Artificial Sequence: Synthetic polypeptide
VELLRSFFYVTETTFQKNRLFFYRKSVWSKLQSIGIRQHL

SEQ ID NO: 9350 - protein, 40 aa, Artificial Sequence
  Description of Artificial Sequence: Synthetic polypeptide
ELLRSFFYVTETTFQKNRLFFYRKSVWSKLQSIGIRQHLK

SEQ ID NO: 9351 - protein, 40 aa, Artificial Sequence
  Description of Artificial Sequence: Synthetic polypeptide
MLRSFFYVTETTFQKNRLFFYRKSVWSKLQSIGIRQHLKR

SEQ ID NO: 9352 - protein, 40 aa, Artificial Sequence
  Description of Artificial Sequence: Synthetic polypeptide
LRSFFYVTETTFQKNRLFFYRKSVWSKLQSIGIRQHLKRV

SEQ ID NO: 9353 - protein, 40 aa, Artificial Sequence
  Description of Artificial Sequence: Synthetic polypeptide
YVTETTFQKNRLFFYRKSVWSKLQSIGIRQHLKRVQLREL

SEQ ID NO: 9354 - protein, 40 aa, Artificial Sequence
  Description of Artificial Sequence: Synthetic polypeptide
VTETTFQKNRLFFYRKSVWSKLQSIGIRQHLKRVQLRELS

SEQ ID NO: 9355 - protein, 40 aa, Artificial Sequence
  Description of Artificial Sequence: Synthetic polypeptide
SRLRFIPKPDGLRPIVNMDYVVGARTFRREKRAERLTSRV

SEQ ID NO: 9356 - protein, 40 aa, Artificial Sequence
  Description of Artificial Sequence: Synthetic polypeptide
VVGARTFRREKRAERLTSRVKALFSVLNYERARRPGLLGA

SEQ ID NO: 9357 - protein, 40 aa, Artificial Sequence
  Description of Artificial Sequence: Synthetic polypeptide
GARTFRREKRAERLTSRVKALFSVLNYERARRPGLLGASV

SEQ ID NO: 9358 - protein, 40 aa, Artificial Sequence
  Description of Artificial Sequence: Synthetic polypeptide
RTFRREKRAERLTSRVKALFSVLNYERARRPGLLGASVLG

SEQ ID NO: 9359 - protein, 40 aa, Artificial Sequence
  Description of Artificial Sequence: Synthetic polypeptide
TFRREKRAERLTSRVKALFSVLNYERARRPGLLGASVLGL

SEQ ID NO: 9360 - protein, 40 aa, Artificial Sequence
  Description of Artificial Sequence: Synthetic polypeptide
FRREKRAERLTSRVKALFSVLNYERARRPGLLGASVLGLD

SEQ ID NO: 9361 - protein, 40 aa, Artificial Sequence
  Description of Artificial Sequence: Synthetic polypeptide
REKRAERLTSRVKALFSVLNYERARRPGLLGASVLGLDDI

SEQ ID NO: 9362 - protein, 40 aa, Artificial Sequence
  Description of Artificial Sequence: Synthetic polypeptide
KRAERLTSRVKALFSVLNYERARRPGLLGASVLGLDDIHR

SEQ ID NO: 9363 - protein, 40 aa, Artificial Sequence
  Description of Artificial Sequence: Synthetic polypeptide
ERLTSRVKALFSVLNYERARRPGLLGASVLGLDDIHRAWR

SEQ ID NO: 9364 - protein, 40 aa, Artificial Sequence
  Description of Artificial Sequence: Synthetic polypeptide
RLTSRVKALFSVLNYERARRPGLLGASVLGLDDIHRAWRT

SEQ ID NO: 9365 - protein, 40 aa, Artificial Sequence
  Description of Artificial Sequence: Synthetic polypeptide
TSRVKALFSVLNYERARRPGLLGASVLGLDDIHRAWRTFV

SEQ ID NO: 9366 - protein, 40 aa, Artificial Sequence
  Description of Artificial Sequence: Synthetic polypeptide
SRVKALFSVLNYERARRPGLLGASVLGLDDIHRAWRTFVL

SEQ ID NO: 9367 - protein, 40 aa, Artificial Sequence
  Description of Artificial Sequence: Synthetic polypeptide
RVKALFSVLNYERARRPGLLGASVLGLDDIHRAWRTFVLR

SEQ ID NO: 9368 - protein, 40 aa, Artificial Sequence
  Description of Artificial Sequence: Synthetic polypeptide
VKALFSVLNYERARRPGLLGASVLGLDDIHRAWRTFVLRV

SEQ ID NO: 9369 - protein, 40 aa, Artificial Sequence
  Description of Artificial Sequence: Synthetic polypeptide
KALFSVLNYERARRPGLLGASVLGLDDIHRAWRTFVLRVR

SEQ ID NO: 9370 - protein, 40 aa, Artificial Sequence
  Description of Artificial Sequence: Synthetic polypeptide
ALFSVLNYERARRPGLLGASVLGLDDIHRAWRTFVLRVRA

SEQ ID NO: 9371 - protein, 40 aa, Artificial Sequence
  Description of Artificial Sequence: Synthetic polypeptide
FSVLNYERARRPGLLGASVLGLDDIHRAWRTFVLRVRAQD

SEQ ID NO: 9372 - protein, 40 aa, Artificial Sequence
  Description of Artificial Sequence: Synthetic polypeptide
SVLNYERARRPGLLGASVLGLDDIHRAWRTFVLRVRAQDP

SEQ ID NO: 9373 - protein, 40 aa, Artificial Sequence
  Description of Artificial Sequence: Synthetic polypeptide
VLNYERARRPGLLGASVLGLDDIHRAWRTFVLRVRAQDPP

SEQ ID NO: 9374 - protein, 40 aa, Artificial Sequence
  Description of Artificial Sequence: Synthetic polypeptide
YERARRPGLLGASVLGLDDIHRAWRTFVLRVRAQDPPPEL

SEQ ID NO: 9375 - protein, 40 aa, Artificial Sequence
  Description of Artificial Sequence: Synthetic polypeptide
ERARRPGLLGASVLGLDDIHRAWRTFVLRVRAQDPPPELY

SEQ ID NO: 9376 - protein, 40 aa, Artificial Sequence
  Description of Artificial Sequence: Synthetic polypeptide
ARRPGLLGASVLGLDDIHRAWRTFVLRVRAQDPPPELYFV

SEQ ID NO: 9377 - protein, 40 aa, Artificial Sequence
  Description of Artificial Sequence: Synthetic polypeptide
LLGASVLGLDDIHRAWRTFVLRVRAQDPPPELYFVKVDVT

SEQ ID NO: 9378 - protein, 40 aa, Artificial Sequence
  Description of Artificial Sequence: Synthetic polypeptide
GASVLGLDDIHRAWRTFVLRVRAQDPPPELYFVKVDVTGA

SEQ ID NO: 9379 - protein, 40 aa, Artificial Sequence
  Description of Artificial Sequence: Synthetic polypeptide
ASVLGLDDIHRAWRTFVLRVRAQDPPPELYFVKVDVTGAY

SEQ ID NO: 9380 - protein, 40 aa, Artificial Sequence
  Description of Artificial Sequence: Synthetic polypeptide
DIHRAWRTFVLRVRAQDPPPELYFVKVDVTGAYDTIPQDR

SEQ ID NO: 9381 - protein, 40 aa, Artificial Sequence
  Description of Artificial Sequence: Synthetic polypeptide
MRQFVAHLQETSPLRDAVVIEQSSSLNEASSGLFDVFLRF

SEQ ID NO: 9382 - protein, 40 aa, Artificial Sequence
  Description of Artificial Sequence: Synthetic polypeptide
EASSGLFDVFLRFMCHHAVRIRGKSYVQCQGIPQGSILST

SEQ ID NO: 9383 - protein, 40 aa, Artificial Sequence
  Description of Artificial Sequence: Synthetic polypeptide
TAFVQMPAHGLFPWCGLLLDTRTLEVQSDYSSYARTSIRA

SEQ ID NO: 9384 - protein, 40 aa, Artificial Sequence
  Description of Artificial Sequence: Synthetic polypeptide
GFKAGRNMRRKLFGVLRLKCHSLFLDLQVNSLQTVCTNIY

SEQ ID NO: 9385 - protein, 40 aa, Artificial Sequence
  Description of Artificial Sequence: Synthetic polypeptide
KAGRNMRRKLFGVLRLKCHSLFLDLQVNSLQTVCTNIYKI

SEQ ID NO: 9386 - protein, 40 aa, Artificial Sequence
  Description of Artificial Sequence: Synthetic polypeptide
MRRKLFGVLRLKCHSLFLDLQVNSLQTVCTNIYKILLLQA

SEQ ID NO: 9387 - protein, 40 aa, Artificial Sequence
  Description of Artificial Sequence: Synthetic polypeptide
MRLKCHSLFLDLQVNSLQTVCTNIYKILLLQAYRFHACVL

SEQ ID NO: 9388 - protein, 40 aa, Artificial Sequence
  Description of Artificial Sequence: Synthetic polypeptide
HACVLQLPFHQQVWKNPTFFLRVISDTASLCYSILKAKNA

SEQ ID NO: 9389 - protein, 40 aa, Artificial Sequence
  Description of Artificial Sequence: Synthetic polypeptide
SLGAKGAAGPLPSEAVQWLCHQAFLLKLTRHRVTYVPLLG

SEQ ID NO: 9390 - protein, 40 aa, Artificial Sequence
  Description of Artificial Sequence: Synthetic polypeptide
YVPLLGSLRTAQTQLSRKLPGTTLTALEAAANPALPSDFK

SEQ ID NO: 9391 - protein, 40 aa, Artificial Sequence
  Description of Artificial Sequence: Synthetic polypeptide
MHIVLWTRIASTIPPHVQKSVNNDMIVTDNNGAVKFPQLC

SEQ ID NO: 9392 - protein, 40 aa, Artificial Sequence
  Description of Artificial Sequence: Synthetic polypeptide
HVQKSVNNDMIVTDNNGAVKFPQLCKFCDVRFSTCDNQKS

SEQ ID NO: 9393 - protein, 40 aa, Artificial Sequence
  Description of Artificial Sequence: Synthetic polypeptide
VQKSVNNDMIVTDNNGAVKFPQLCKFCDVRFSTCDNQKSC

SEQ ID NO: 9394 - protein, 40 aa, Artificial Sequence
  Description of Artificial Sequence: Synthetic polypeptide
AVKFPQLCKFCDVRFSTCDNQKSCMSNCSITSICEKPQEV

SEQ ID NO: 9395 - protein, 40 aa, Artificial Sequence
  Description of Artificial Sequence: Synthetic polypeptide
QLCKFCDVRFSTCDNQKSCMSNCSITSICEKPQEVCVAVW

SEQ ID NO: 9396 - protein, 40 aa, Artificial Sequence
  Description of Artificial Sequence: Synthetic polypeptide
NDENITLETVCHDPKLPYHDFILEDAASPKCIMKEKKKPG

SEQ ID NO: 9397 - protein, 40 aa, Artificial Sequence
  Description of Artificial Sequence: Synthetic polypeptide
CIMKEKKKPGETFFMCSCSSDECNDNIIFSEEYNTSNPDL

SEQ ID NO: 9398 - protein, 40 aa, Artificial Sequence
  Description of Artificial Sequence: Synthetic polypeptide
IMKEKKKPGETFFMCSCSSDECNDNIIFSEEYNTSNPDLL

SEQ ID NO: 9399 - protein, 40 aa, Artificial Sequence
  Description of Artificial Sequence: Synthetic polypeptide
MKEKKKPGETFFMCSCSSDECNDNIIFSEEYNTSNPDLLL

SEQ ID NO: 9400 - protein, 40 aa, Artificial Sequence
  Description of Artificial Sequence: Synthetic polypeptide
KEKKKPGETFFMCSCSSDECNDNIIFSEEYNTSNPDLLLV

SEQ ID NO: 9401 - protein, 40 aa, Artificial Sequence
  Description of Artificial Sequence: Synthetic polypeptide
KKKPGETFFMCSCSSDECNDNIIFSEEYNTSNPDLLLVIF

SEQ ID NO: 9402 - protein, 40 aa, Artificial Sequence
  Description of Artificial Sequence: Synthetic polypeptide
TGISLLPPLGVAISVIIIFYCYRVNRQQKLSSTWETGKTR

SEQ ID NO: 9403 - protein, 40 aa, Artificial Sequence
  Description of Artificial Sequence: Synthetic polypeptide
PIELDTLVGKGRFAEVYKAKLKQNTSEQFETVAVKIFPYE

SEQ ID NO: 9404 - protein, 40 aa, Artificial Sequence
  Description of Artificial Sequence: Synthetic polypeptide
VAVKIFPYEEYASWKTEKDIFSDINLKHENILQFLTAEER

SEQ ID NO: 9405 - protein, 40 aa, Artificial Sequence
  Description of Artificial Sequence: Synthetic polypeptide
HRDLKSSNILVKNDLTCCLCDFGLSLRLDPTLSVDDLANS

SEQ ID NO: 9406 - protein, 40 aa, Artificial Sequence
  Description of Artificial Sequence: Synthetic polypeptide
LKSSNILVKNDLTCCLCDFGLSLRLDPTLSVDDLANSGQV

SEQ ID NO: 9407 - protein, 40 aa, Artificial Sequence
  Description of Artificial Sequence: Synthetic polypeptide
CCLCDFGLSLRLDPTLSVDDLANSGQVGTARYMAPEVLES

SEQ ID NO: 9408 - protein, 40 aa, Artificial Sequence
  Description of Artificial Sequence: Synthetic polypeptide
LSLRLDPTLSVDDLANSGQVGTARYMAPEVLESRMNLENV

SEQ ID NO: 9409 - protein, 40 aa, Artificial Sequence
  Description of Artificial Sequence: Synthetic polypeptide
DPTLSVDDLANSGQVGTARYMAPEVLESRMNLENVESFKQ

SEQ ID NO: 9410 - protein, 40 aa, Artificial Sequence
  Description of Artificial Sequence: Synthetic polypeptide
VYSMALVLWEMTSRCNAVGEVKDYEPPFGSKVREHPCVES

SEQ ID NO: 9411 - protein, 40 aa, Artificial Sequence
  Description of Artificial Sequence: Synthetic polypeptide
TSRCNAVGEVKDYEPPFGSKVREHPCVESMKDNVLRDRGR

SEQ ID NO: 9412 - protein, 40 aa, Artificial Sequence
  Description of Artificial Sequence: Synthetic polypeptide
NAVGEVKDYEPPFGSKVREHPCVESMKDNVLRDRGRPEIP

SEQ ID NO: 9413 - protein, 40 aa, Artificial Sequence
  Description of Artificial Sequence: Synthetic polypeptide
GEVKDYEPPFGSKVREHPCVESMKDNVLRDRGRPEIPSFW

SEQ ID NO: 9414 - protein, 40 aa, Artificial Sequence
  Description of Artificial Sequence: Synthetic polypeptide
PSFWLNHQGIQMVCETLTECWDHDPEARLTAQCVAERFSE

SEQ ID NO: 9415 - protein, 40 aa, Artificial Sequence
  Description of Artificial Sequence: Synthetic polypeptide
WLNHQGIQMVCETLTECWDHDPEARLTAQCVAERFSELEH

SEQ ID NO: 9416 - protein, 40 aa, Artificial Sequence
  Description of Artificial Sequence: Synthetic polypeptide
HQGIQMVCETLTECWDHDPEARLTAQCVAERFSELEHLDR

SEQ ID NO: 9417 - protein, 40 aa, Artificial Sequence
  Description of Artificial Sequence: Synthetic polypeptide
QMVCETLTECWDHDPEARLTAQCVAERFSELEHLDRLSGR

SEQ ID NO: 9418 - protein, 40 aa, Artificial Sequence
  Description of Artificial Sequence: Synthetic polypeptide
APAAPTPAAPAPAPSWPLSSSVPSQKTYQGSYGFRLGFLH

SEQ ID NO: 9419 - protein, 40 aa, Artificial Sequence
  Description of Artificial Sequence: Synthetic polypeptide
PAAPTPAAPAPAPSWPLSSSVPSQKTYQGSYGFRLGFLHS

SEQ ID NO: 9420 - protein, 40 aa, Artificial Sequence
  Description of Artificial Sequence: Synthetic polypeptide
PTPAAPAPAPSWPLSSSVPSQKTYQGSYGFRLGFLHSGTA

SEQ ID NO: 9421 - protein, 40 aa, Artificial Sequence
  Description of Artificial Sequence: Synthetic polypeptide
APAPAPSWPLSSSVPSQKTYQGSYGFRLGFLHSGTAKSVT

SEQ ID NO: 9422 - protein, 40 aa, Artificial Sequence
  Description of Artificial Sequence: Synthetic polypeptide
PAPSWPLSSSVPSQKTYQGSYGFRLGFLHSGTAKSVTCTY

SEQ ID NO: 9423 - protein, 40 aa, Artificial Sequence
  Description of Artificial Sequence: Synthetic polypeptide
APSWPLSSSVPSQKTYQGSYGFRLGFLHSGTAKSVTCTYS

SEQ ID NO: 9424 - protein, 40 aa, Artificial Sequence
  Description of Artificial Sequence: Synthetic polypeptide
WPLSSSVPSQKTYQGSYGFRLGFLHSGTAKSVTCTYSPAL

SEQ ID NO: 9425 - protein, 40 aa, Artificial Sequence
  Description of Artificial Sequence: Synthetic polypeptide
DSDGLAPPQHLIRVEGNLRVEYLDDRNTFRHSVVVPYEPP

SEQ ID NO: 9426 - protein, 40 aa, Artificial Sequence
  Description of Artificial Sequence: Synthetic polypeptide
DGLAPPQHLIRVEGNLRVEYLDDRNTFRHSVVVPYEPPEV

SEQ ID NO: 9427 - protein, 40 aa, Artificial Sequence
  Description of Artificial Sequence: Synthetic polypeptide
YMCNSSCMGGMNRRPILTIITLEDSSGNLLGRNSFEVRVC

SEQ ID NO: 9428 - protein, 40 aa, Artificial Sequence
  Description of Artificial Sequence: Synthetic polypeptide
CNSSCMGGMNRRPILTIITLEDSSGNLLGRNSFEVRVCAC

SEQ ID NO: 9429 - protein, 40 aa, Artificial Sequence
  Description of Artificial Sequence: Synthetic polypeptide
SCMGGMNRRPILTIITLEDSSGNLLGRNSFEVRVCACPGR

SEQ ID NO: 9430 - protein, 40 aa, Artificial Sequence
  Description of Artificial Sequence: Synthetic polypeptide
MGGMNRRPILTIITLEDSSGNLLGRNSFEVRVCACPGRDR

SEQ ID NO: 9431 - protein, 40 aa, Artificial Sequence
  Description of Artificial Sequence: Synthetic polypeptide
GGMNRRPILTIITLEDSSGNLLGRNSFEVRVCACPGRDRR

SEQ ID NO: 9432 - protein, 40 aa, Artificial Sequence
  Description of Artificial Sequence: Synthetic polypeptide
HELPPGSTKRALPNNTSSSPQPKKKPLDGEYFTLQIRGRE

SEQ ID NO: 9433 - protein, 40 aa, Artificial Sequence
  Description of Artificial Sequence: Synthetic polypeptide
EEDGGEESGAEESGPEESGPEELGAEEEMEAGRPRPVLRS

SEQ ID NO: 9434 - protein, 40 aa, Artificial Sequence
  Description of Artificial Sequence: Synthetic polypeptide
PSLNVDGQPIFANITLPVYTLKERCLQVVRSLVKPENYRR

SEQ ID NO: 9435 - protein, 40 aa, Artificial Sequence
  Description of Artificial Sequence: Synthetic polypeptide
DGQPIFANITLPVYTLKERCLQVVRSLVKPENYRRLDIVR

SEQ ID NO: 9436 - protein, 40 aa, Artificial Sequence
  Description of Artificial Sequence: Synthetic polypeptide
QPIFANITLPVYTLKERCLQVVRSLVKPENYRRLDIVRSL

SEQ ID NO: 9437 - protein, 40 aa, Artificial Sequence
  Description of Artificial Sequence: Synthetic polypeptide
NITLPVYTLKERCLQVVRSLVKPENYRRLDIVRSLYEDLE

SEQ ID NO: 9438 - protein, 40 aa, Artificial Sequence
  Description of Artificial Sequence: Synthetic polypeptide
LQVVRSLVKPENYRRLDIVRSLYEDLEDHPNVQKDLERLT

SEQ ID NO: 9439 - protein, 40 aa, Artificial Sequence
  Description of Artificial Sequence: Synthetic polypeptide
VKPENYRRLDIVRSLYEDLEDHPNVQKDLERLTQERIAHQ

SEQ ID NO: 9440 - protein, 40 aa, Artificial Sequence
  Description of Artificial Sequence: Synthetic polypeptide
ENYRRLDIVRSLYEDLEDHPNVQKDLERLTQERIAHQRMG

SEQ ID NO: 9441 - protein, 40 aa, Artificial Sequence
  Description of Artificial Sequence: Synthetic polypeptide
GQQPPPQPAPQGQGQPPSQPPQGQGPPSGPGQPAPAATQA

SEQ ID NO: 9442 - protein, 40 aa, Artificial Sequence
  Description of Artificial Sequence: Synthetic polypeptide
QQPPPQPAPQGQGQPPSQPPQGQGPPSGPGQPAPAATQAA

SEQ ID NO: 9443 - protein, 40 aa, Artificial Sequence
  Description of Artificial Sequence: Synthetic polypeptide
QPPPQPAPQGQGQPPSQPPQGQGPPSGPGQPAPAATQAAP

SEQ ID NO: 9444 - protein, 40 aa, Artificial Sequence
  Description of Artificial Sequence: Synthetic polypeptide
QPAPQGQGQPPSQPPQGQGPPSGPGQPAPAATQAAPQAPP

SEQ ID NO: 9445 - protein, 40 aa, Artificial Sequence
  Description of Artificial Sequence: Synthetic polypeptide
APQGQGQPPSQPPQGQGPPSGPGQPAPAATQAAPQAPPAG

SEQ ID NO: 9446 - protein, 40 aa, Artificial Sequence
  Description of Artificial Sequence: Synthetic polypeptide
QGQGQPPSQPPQGQGPPSGPGQPAPAATQAAPQAPPAGHQ

SEQ ID NO: 9447 - protein, 40 aa, Artificial Sequence
  Description of Artificial Sequence: Synthetic polypeptide
GQGQPPSQPPQGQGPPSGPGQPAPAATQAAPQAPPAGHQI

SEQ ID NO: 9448 - protein, 40 aa, Artificial Sequence
  Description of Artificial Sequence: Synthetic polypeptide
QGQPPSQPPQGQGPPSGPGQPAPAATQAAPQAPPAGHQIV

SEQ ID NO: 9449 - protein, 40 aa, Artificial Sequence
  Description of Artificial Sequence: Synthetic polypeptide
PPSQPPQGQGPPSGPGQPAPAATQAAPQAPPAGHQIVHVR

SEQ ID NO: 9450 - protein, 40 aa, Artificial Sequence
  Description of Artificial Sequence: Synthetic polypeptide
QGQGPPSGPGQPAPAATQAAPQAPPAGHQIVHVRGDSETD

SEQ ID NO: 9451 - protein, 40 aa, Artificial Sequence
  Description of Artificial Sequence: Synthetic polypeptide
GQGPPSGPGQPAPAATQAAPQAPPAGHQIVHVRGDSETDL

SEQ ID NO: 9452 - protein, 40 aa, Artificial Sequence
  Description of Artificial Sequence: Synthetic polypeptide
ASLQLGAVSPGTLTPTGVVSGPAATPTAQHLRQSSFEIPD

SEQ ID NO: 9453 - protein, 40 aa, Artificial Sequence
  Description of Artificial Sequence: Synthetic polypeptide
LRQSSFEIPDDVPLPAGWEMAKTSSGQRYFLNHIDQTTTW

SEQ ID NO: 9454 - protein, 40 aa, Artificial Sequence
  Description of Artificial Sequence: Synthetic polypeptide
VQQNMMNSASGPLPDGWEQAMTQDGEIYYINHKNKTTSWL

SEQ ID NO: 9455 - protein, 40 aa, Artificial Sequence
  Description of Artificial Sequence: Synthetic polypeptide
NQRISQSAPVKQPPPLAPQSPQGGVMGGSNSNQQQQMRLQ

SEQ ID NO: 9456 - protein, 40 aa, Artificial Sequence
  Description of Artificial Sequence: Synthetic polypeptide
QNRFPDYLEAIPGTNVDLGTLEGDGMNIEGEELMPSLQEA

SEQ ID NO: 9457 - protein, 40 aa, Artificial Sequence
  Description of Artificial Sequence: Synthetic polypeptide
FPDYLEAIPGTNVDLGTLEGDGMNIEGEELMPSLQEALSS

SEQ ID NO: 9458 - protein, 40 aa, Artificial Sequence
  Description of Artificial Sequence: Synthetic polypeptide
PDYLEAIPGTNVDLGTLEGDGMNIEGEELMPSLQEALSSD

SEQ ID NO: 9459 - protein, 40 aa, Artificial Sequence
  Description of Artificial Sequence: Synthetic polypeptide
NIEGEELMPSLQEALSSDILNDMESVLAATKLDKESFLTW

SEQ ID NO: 9460 - protein, 40 aa, Artificial Sequence
  Description of Artificial Sequence: Synthetic polypeptide
FLDKFNHEAEDLFYQSSLASWNYNTNITEENVQNMNNAGD

SEQ ID NO: 9461 - protein, 40 aa, Artificial Sequence
  Description of Artificial Sequence: Synthetic polypeptide
FLKEQSTLAQMYPLQEIQNLTVKLQLQALQQNGSSVLSED

SEQ ID NO: 9462 - protein, 40 aa, Artificial Sequence
  Description of Artificial Sequence: Synthetic polypeptide
FLKVKNQMILFGEEDVRVANLKPRISFNFFVTAPKNVSDI

SEQ ID NO: 9463 - protein, 40 aa, Artificial Sequence
  Description of Artificial Sequence: Synthetic polypeptide
FFVSVGLPNMTQGFWENSMLTDPGNVQKAVCHPTAWDLGK

SEQ ID NO: 9464 - protein, 81 aa, Artificial Sequence
  Description of Artificial Sequence: Synthetic polypeptide
VTAAQSTIEEQAKTFLDKFNHEAEDLFYQSSLASWNYNTNITEENVQNMNNAGDKWSAFLKEQSTLAQMYPLQEIQNLTVK

SEQ ID NO: 9465 - protein, 44 aa, Artificial Sequence
  Description of Artificial Sequence: Synthetic polypeptide
IEEQAKTFLDKFNHEAEDLFYQSSLASWNYNTNITWDLGKGDFR

SEQ ID NO: 9466 - protein, 125 aa, Artificial Sequence
  Description of Artificial Sequence: Synthetic polypeptide
IEEQAKTFLDKFNHEAEDLFYQSSLASWNYNTNITEENVQNMNNAGDKWSAFLKEQSTLAQMYPLQEIQNLTVKLQLQALQQNGSMTQGFWENSMLTDPGNVQKAVCHPTAWDLGKGDFRILMCT

SEQ ID NO: 9467 - protein, 141 aa, Artificial Sequence
  Description of Artificial Sequence: Synthetic polypeptide
IEEQAKTFLDKFNHEAEDLFYQSSLASWNYNTNITEENVQNMNNAGDKWSAFLKEQSTLAQMYPLQEIQNLTVKLDPGNVQKAVCHPTAWDLGKGDFRILMCTKVTMDDFLTAHHEMGHIQYDMAYAAQPFLLRNGANEGF

SEQ ID NO: 9468 - protein, 87 aa, Artificial Sequence
  Description of Artificial Sequence: Synthetic polypeptide
AAQSTIEEQAKTFLDKFNHEAEDLFYQSSLASWNYNTNITGGSGSGSMTQGFWENSMLTDPGNVQKAVCHPTAWDLGKGDFRILMCT

SEQ ID NO: 9469 - protein, 40 aa, Artificial Sequence
  Description of Artificial Sequence: Synthetic polypeptide
VTAAQSTIEEQAKTFLDKFNHEAEDLFYQSSLASWNYNTN

SEQ ID NO: 9470 - protein, 40 aa, Artificial Sequence
  Description of Artificial Sequence: Synthetic polypeptide
TEENVQNMNNAGDKWSAFLKEQSTLAQMYPLQEIQNLTVK

SEQ ID NO: 9471 - protein, 40 aa, Artificial Sequence
  Description of Artificial Sequence: Synthetic polypeptide
EGIDLVTDEAEASKFVEEYDRTSQVVWNEYAEANWNYNTN

SEQ ID NO: 9472 - protein, 40 aa, Artificial Sequence
  Description of Artificial Sequence: Synthetic polypeptide
TTETSKILLQKNMQIANHTLKYGTQARKFDVNQLQNTTIK

SEQ ID NO: 9473 - protein, 40 aa, Artificial Sequence
  Description of Artificial Sequence: Synthetic polypeptide
QHGYEAGSVALHVEKLPNEPNRLLILHGFLDENVHFFHTN

SEQ ID NO: 9474 - protein, 45 aa, Artificial Sequence
  Description of Artificial Sequence: Synthetic polypeptide
LVSQLIRAGKPYQLQIYPNERHSIRCPESGEHYEVTLLHFLQEYL

SEQ ID NO: 9475 - protein, 40 aa, Artificial Sequence
  Description of Artificial Sequence: Synthetic polypeptide
DHSAIPVINRAQIINDAFNLASAHKVPVTLALNNTLFLIE

SEQ ID NO: 9476 - protein, 40 aa, Artificial Sequence
  Description of Artificial Sequence: Synthetic polypeptide
YFKLMFDRSEVYGPMKNYLKKQVTPLFIHFRNNTNNWREI

SEQ ID NO: 9477 - protein, 40 aa, Artificial Sequence
  Description of Artificial Sequence: Synthetic polypeptide
DNLEHYKNSTVMARAEYFRNVDYLLIHGTADDNVHFQNSA

SEQ ID NO: 9478 - protein, 40 aa, Artificial Sequence
  Description of Artificial Sequence: Synthetic polypeptide
QVDFQAMWYSDQNHGLSGLSTNHLYTHMTHFLKQCFSLSD

SEQ ID NO: 9479 - protein, 40 aa, Artificial Sequence
  Description of Artificial Sequence: Synthetic polypeptide
DNLDHYRNSTVMSRAENFKQVEYLLIHGTADDNVHFQQSA

SEQ ID NO: 9480 - protein, 40 aa, Artificial Sequence
  Description of Artificial Sequence: Synthetic polypeptide
GVDFQAMWYTDEDHGIASSTAHQHIYTHMSHFIKQCFSLP

SEQ ID NO: 9481 - protein, 40 aa, Artificial Sequence
  Description of Artificial Sequence: Synthetic polypeptide
IGFKLGVRPSQGGEAPREVTSDSGSIVVSGLTPGVEYVYT

SEQ ID NO: 9482 - protein, 40 aa, Artificial Sequence
  Description of Artificial Sequence: Synthetic polypeptide
PGLEYNVSVYTVKDDKESVPISDTIIPEVPQLTDLSFVDI

SEQ ID NO: 9483 - protein, 78 aa, Artificial Sequence
  Description of Artificial Sequence: Synthetic polypeptide
KFFVVNTDSLSSVTNATSIQITAPASMLIGDHYLCDVTWATQERISLQWLRRIQNYSVMDICDYDESSGRWNCLVARQ

SEQ ID NO: 9484 - protein, 80 aa, Artificial Sequence
  Description of Artificial Sequence: Synthetic polypeptide
QNYDADQKFGFCPMAAHEEICTTNEGVMYRIGDQWDKQHDMGHMMRCTCVGNGRGEWTCIAYSQLRDQCIVDDITYNVND

SEQ ID NO: 9485 - protein, 80 aa, Artificial Sequence
  Description of Artificial Sequence: Synthetic polypeptide
RIFIIDTTYPAYVGPQEVPVPAMIASSDYYFSWLTWVTDERVCLQWLKRVQNVSVLSICDFREDWQTWDCPKTQEHIEES

SEQ ID NO: 9486 - protein, 50 aa, Artificial Sequence
  Description of Artificial Sequence: Synthetic polypeptide
LVTYRENSLLFDPLSSSSSNKERVVTVIAHELAHQWFGNLVTIEWWNDLW

SEQ ID NO: 9487 - protein, 100 aa, Artificial Sequence
  Description of Artificial Sequence: Synthetic polypeptide
TFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEE

SEQ ID NO: 9488 - protein, 100 aa, Artificial Sequence
  Description of Artificial Sequence: Synthetic polypeptide
ALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEE

SEQ ID NO: 9489 - protein, 40 aa, Artificial Sequence
  Description of Artificial Sequence: Synthetic polypeptide
AFVRRALHRRYGDRYINLRGPIPAHLLGDMWAQSWENIYD

SEQ ID NO: 9490 - protein, 9 aa, Artificial Sequence
  Description of Artificial Sequence: Synthetic polypeptide
RKKRRQRRR

SEQ ID NO: 9491 - protein, 16 aa, Artificial Sequence
  Description of Artificial Sequence: Synthetic polypeptide
RQIKIWFQNRRMKWKK

SEQ ID NO: 9492 - protein, 21 aa, Artificial Sequence
  Description of Artificial Sequence: Synthetic polypeptide
TRSSRAGLQFPVGRVHRLLRK

SEQ ID NO: 9493 - protein, 26 aa, Artificial Sequence
  Description of Artificial Sequence: Synthetic polypeptide
GWTLNSAGYLLGKINKALAALAKKIL

SEQ ID NO: 9494 - protein, 18 aa, Artificial Sequence
  Description of Artificial Sequence: Synthetic polypeptide
KLALKLALKALKAALKLA

SEQ ID NO: 9495 - protein, 16 aa, Artificial Sequence
  Description of Artificial Sequence: Synthetic polypeptide
AAVALLPAVLLALLAP

SEQ ID NO: 9496 - protein, 10 aa, Artificial Sequence
  Description of Artificial Sequence: Synthetic polypeptide
VPMLKPMLKE

SEQ ID NO: 9497 - protein, 28 aa, Artificial Sequence
  Description of Artificial Sequence: Synthetic polypeptide
MANLGYWLLALFVTMWTDVGLCKKRPKP

SEQ ID NO: 9498 - protein, 18 aa, Artificial Sequence
  Description of Artificial Sequence: Synthetic polypeptide
LLIILRRRIRKQAHAHSK

SEQ ID NO: 9499 - protein, 21 aa, Artificial Sequence
  Description of Artificial Sequence: Synthetic polypeptide
KETWWETWWTEWSQPKKKRKV

SEQ ID NO: 9500 - protein, 18 aa, Artificial Sequence
  Description of Artificial Sequence: Synthetic polypeptide
RGGRLSYSRRRFSTSTGR

SEQ ID NO: 9501 - protein, 15 aa, Artificial Sequence
  Description of Artificial Sequence: Synthetic polypeptide
SDLWEMMMVSLACQY

SEQ ID NO: 9502 - protein, 12 aa, Artificial Sequence
  Description of Artificial Sequence: Synthetic polypeptide
TSPLNIHNGQKL

SEQ ID NO: 9503 - protein, 8 aa, Artificial Sequence
  Description of Artificial Sequence: Consensus sequence
  MISC_FEATURE (1)..(1): X is a basic amino acid
  MISC_FEATURE (2)..(4): X is a an alpha-helix enhancing amino acid
  MISC_FEATURE (5)..(5): X is a basic amino acid
  MISC_FEATURE (6)..(7): X is a an alpha-helix enhancing amino acid
  MISC_FEATURE (8)..(8): X is a basic amino acid
XXXXXXXX

SEQ ID NO: 9504 - protein, 8 aa, Artificial Sequence
  Description of Artificial Sequence: Consensus sequence
  MISC_FEATURE (1)..(1): X is a basic amino acid
  MISC_FEATURE (2)..(3): X is a an alpha-helix enhancing amino acid
  MISC_FEATURE (4)..(5): X is a basic amino acid
  MISC_FEATURE (6)..(7): X is a an alpha-helix enhancing amino acid
  MISC_FEATURE (8)..(8): X is a basic amino acid
XXXXXXXX

SEQ ID NO: 9505 - protein, 7 aa, Artificial Sequence
  Description of Artificial Sequence: Synthetic polypeptide
KKRPKPG

SEQ ID NO: 9506 - protein, 5 aa, Artificial Sequence
  Description of Artificial Sequence: Synthetic polypeptide
GGGGS

SEQ ID NO: 9507 - protein, 12 aa, Artificial Sequence
  Description of Artificial Sequence: Synthetic polypeptide
GKSSGSGSESKS

SEQ ID NO: 9508 - protein, 14 aa, Artificial Sequence
  Description of Artificial Sequence: Synthetic polypeptide
GSTSGSGKSSEGKG

SEQ ID NO: 9509 - protein, 18 aa, Artificial Sequence
  Description of Artificial Sequence: Synthetic polypeptide
GSTSGSGKSSEGSGSTKG

SEQ ID NO: 9510 - protein, 18 aa, Artificial Sequence
  Description of Artificial Sequence: Synthetic polypeptide
GSTSGSGKPGSGEGSTKG

SEQ ID NO: 9511 - protein, 14 aa, Artificial Sequence
  Description of Artificial Sequence: Synthetic polypeptide
EGKSSGSGSESKEF

SEQ ID NO: 9512 - DNA, 30 bp, Artificial Sequence
  Description of Artificial Sequence: Primer
ggctaggtaagcttgatatcggccaccatg

SEQ ID NO: 9513 - DNA, 30 bp, Artificial Sequence
  Description of Artificial Sequence: Primer
ggcggcactgtttaacaagcccgtcagtag

SEQ ID NO: 9514 - DNA, 53 bp, Artificial Sequence
  Description of Artificial Sequence: Primer
acactctttccctacacgacgctcttccgatctgcttgatatcggccaccatg

SEQ ID NO: 9515 - DNA, 57 bp, Artificial Sequence
  Description of Artificial Sequence: Primer
gactggagttcagacgtgtgctcttccgatctcactgtttaacaagcccgtcagtag

SEQ ID NO: 9516 - DNA, 22 bp, Artificial Sequence
  Description of Artificial Sequence: Primer
tgacggttctgggagcggttct

SEQ ID NO: 9517 - DNA, 22 bp, Artificial Sequence
  Description of Artificial Sequence: Primer
gttcgctgccggacccacttcc

SEQ ID NO: 9518 - DNA, 55 bp, Artificial Sequence
  Description of Artificial Sequence: Primer
acactctttccctacacgacgctcttccgatcttgacggttctgggagcggttct

SEQ ID NO: 9519 - DNA, 54 bp, Artificial Sequence
  Description of Artificial Sequence: Primer
gactggagttcagacgtgtgctcttccgatctgttcgctgccggacccacttcc

SEQ ID NO: 9520 - DNA, 21 bp, Artificial Sequence
  Description of Artificial Sequence: Primer
ttctcaagcctcagacagtgg

SEQ ID NO: 9521 - protein, 60 aa, Artificial Sequence
  Description of Artificial Sequence: Synthetic polypeptide
GRKKRRQRRRPPQGSGSGSMEAPNQALLRILKETEFKKIKVLGSGAFGTVYKGLWIPEGE

SEQ ID NO: 9522 - protein, 60 aa, Artificial Sequence
  Description of Artificial Sequence: Synthetic polypeptide
GRKKRRQRRRPPQGSGSGSMRNGMSLHDCLMKALKVRGLQPECCAVFRLLHEHKGKKARL

SEQ ID NO: 9523 - protein, 41 aa, Artificial Sequence
  Description of Artificial Sequence: Synthetic polypeptide
GRKKRRQRRRPPQGSGSGSDYKDHDGDYKDHDIDYKDDDDK

SEQ ID NO: 9524 - protein, 41 aa, Artificial Sequence
  Description of Artificial Sequence: Synthetic polypeptide
MIDDLIRDQGFRGDGGSTTGLSATPPASLPGSLTNVKALQK

SEQ ID NO: 9525 - protein, 41 aa, Artificial Sequence
  Description of Artificial Sequence: Synthetic polypeptide
MDDLIRDQGFRGDGGSTTGLSATPPASLPGSLTNVKALQKS

SEQ ID NO: 9526 - protein, 41 aa, Artificial Sequence
  Description of Artificial Sequence: Synthetic polypeptide
MEAPNQALLRILKETEFKKIKVLGSGAFGTVYKGLWIPEGE

SEQ ID NO: 9527 - protein, 41 aa, Artificial Sequence
  Description of Artificial Sequence: Synthetic polypeptide
MLRILKETEFKKIKVLGSGAFGTVYKGLWIPEGEKVKIPVA

SEQ ID NO: 9528 - protein, 41 aa, Artificial Sequence
  Description of Artificial Sequence: Synthetic polypeptide
MTSTVRCMHLHEKRVVSGSRDATLRVWDIETGQCLHVLMGH

SEQ ID NO: 9529 - protein, 41 aa, Artificial Sequence
  Description of Artificial Sequence: Synthetic polypeptide
MRRVVSGAYDFMVKVWDPETETCLHTLQGHTNRVYSLQFDG

SEQ ID NO: 9530 - protein, 41 aa, Artificial Sequence
  Description of Artificial Sequence: Synthetic polypeptide
MRNGMSLHDCLMKALKVRGLQPECCAVFRLLHEHKGKKARL

SEQ ID NO: 9531 - protein, 41 aa, Artificial Sequence
  Description of Artificial Sequence: Synthetic polypeptide
MLHDCLMKALKVRGLQPECCAVFRLLHEHKGKKARLDWNTD

SEQ ID NO: 9532 - protein, 41 aa, Artificial Sequence
  Description of Artificial Sequence: Synthetic polypeptide
MIQNHFVDEYDPTIEDSYRKQVVIDGETCLLDILDTAGKEE

SEQ ID NO: 9533 - protein, 41 aa, Artificial Sequence
  Description of Artificial Sequence: Synthetic polypeptide
MFVDEYDPTIEDSYRKQVVIDGETCLLDILDTAGKEEYSAM

SEQ ID NO: 9534 - protein, 41 aa, Artificial Sequence
  Description of Artificial Sequence: Synthetic polypeptide
MPTIEDSYRKQVVIDGETCLLDILDTAGKEEYSAMRDQYMR

SEQ ID NO: 9535 - protein, 41 aa, Artificial Sequence
  Description of Artificial Sequence: Synthetic polypeptide
MRARAPISNYIMLADTDKIKSFEEDLKTYKAIEKILRNKCS

SEQ ID NO: 9536 - protein, 41 aa, Artificial Sequence
  Description of Artificial Sequence: Synthetic polypeptide
METSAKTRQGVDDAFYTLVREIRKHKEKMSKDGKKKKKKSK

SEQ ID NO: 9537 - protein, 41 aa, Artificial Sequence
  Description of Artificial Sequence: Synthetic polypeptide
METLVRPKPLLLKLLKSVGAQKDTYTMKEVLFYLGQYIMTK

SEQ ID NO: 9538 - protein, 41 aa, Artificial Sequence
  Description of Artificial Sequence: Synthetic polypeptide
MKDAFYKNIVKKGYLLKKGKGKRWKNLYFILEGSDAQLIYF

SEQ ID NO: 9539 - DNA, 1440 bp, Homo sapiens
  CDS (1)..(1440)
atgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcc

SEQ ID NO: 9540 - protein, 480 aa, Homo sapiens [sequence omitted]

SEQ ID NO: 9541 - DNA, 2763 bp, Homo sapiens
  CDS (1)..(2763)
atggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtga

SEQ ID NO: 9542 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 9543 - DNA, 1821 bp, Homo sapiens
  CDS (1)..(1821)
atggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgatggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttag

SEQ ID NO: 9544 - protein, 606 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVMVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 9545 - DNA, 2298 bp, Homo sapiens
  CDS (1)..(2298)
atggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccac

SEQ ID NO: 9546 - protein, 766 aa, Homo sapiens [sequence omitted]

SEQ ID NO: 9547 - DNA, 1437 bp, Homo sapiens
  CDS (1)..(1437)
atggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgat

SEQ ID NO: 9548 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 9549 - DNA, 888 bp, Homo sapiens
  CDS (1)..(888)
atggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctga

SEQ ID NO: 9550 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 9551 - DNA, 2646 bp, Homo sapiens
  CDS (1)..(2646)
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgac

SEQ ID NO: 9552 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 9553 - DNA, 468 bp, Homo sapiens
  CDS (1)..(468)
atggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgat

SEQ ID NO: 9554 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 9555 - DNA, 1629 bp, Homo sapiens
  CDS (1)..(1629)
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttg

SEQ ID NO: 9556 - protein, 543 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 9557 - DNA, 2343 bp, Homo sapiens
  CDS (1)..(2343)
atggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctg

SEQ ID NO: 9558 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 9559 - DNA, 1986 bp, Homo sapiens
  CDS (1)..(1986)
atgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaac

SEQ ID NO: 9560 - protein, 662 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 9561 - DNA, 5766 bp, Homo sapiens
  CDS (1)..(5556)
atgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagc

SEQ ID NO: 9562 - protein, 1852 aa, Homo sapiens
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRS

SEQ ID NO: 9563 - DNA, 3633 bp, Homo sapiens
  CDS (1)..(3633)
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatga

SEQ ID NO: 9564 - protein, 1210 aa, Homo sapiens [sequence omitted]

SEQ ID NO: 9565 - DNA, 7245 bp, Homo sapiens
  CDS (1)..(7245)
atggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactag

SEQ ID NO: 9566 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 9567 - DNA, 3765 bp, Homo sapiens
  CDS (1)..(3765)
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtg

SEQ ID NO: 9568 - protein, 1255 aa, Homo sapiens [sequence omitted]

SEQ ID NO: 9569 - DNA, 4026 bp, Homo sapiens
  CDS (1)..(4026)
atgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacg

SEQ ID NO: 9570 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 9571 - DNA, 3924 bp, Homo sapiens
  CDS (1)..(3924)
atgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtg

SEQ ID NO: 9572 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 9573 - DNA, 2124 bp, Homo sapiens
  CDS (1)..(2124)
atgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtga

SEQ ID NO: 9574 - protein, 707 aa, Homo sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 9575 - DNA, 2466 bp, Homo sapiens
  CDS (1)..(2466)
atggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaaca

SEQ ID NO: 9576 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 9577 - DNA, 2418 bp, Homo sapiens
  CDS (1)..(2418)
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacg

SEQ ID NO: 9578 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 9579 - DNA, 2979 bp, Homo sapiens
  CDS (1)..(2979)
atgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcg

SEQ ID NO: 9580 - protein, 993 aa, Homo sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 9581 - DNA, 720 bp, Homo sapiens
  CDS (1)..(720)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 9582 - protein, 239 aa, Homo sapiens
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 9583 - DNA, 1077 bp, Homo sapiens
  CDS (1)..(1077)
atgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtc

SEQ ID NO: 9584 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 9585 - DNA, 1077 bp, Homo sapiens
  CDS (1)..(1077)
atgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtc

SEQ ID NO: 9586 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 9587 - DNA, 657 bp, Homo sapiens
  CDS (1)..(657)
atggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaa

SEQ ID NO: 9588 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 9589 - DNA, 570 bp, Homo sapiens
  CDS (1)..(570)
atgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctga

SEQ ID NO: 9590 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 9591 - DNA, 1242 bp, Homo sapiens
  CDS (1)..(1242)
atgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactt

SEQ ID NO: 9592 - protein, 414 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 9593 - DNA, 1356 bp, Homo sapiens
  CDS (1)..(1356)
atggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcag

SEQ ID NO: 9594 - protein, 452 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 9595 - DNA, 1872 bp, Homo sapiens
  CDS (1)..(1872)
atgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgt

SEQ ID NO: 9596 - protein, 624 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 9597 - DNA, 2928 bp, Homo sapiens
  CDS (1)..(2928)
atgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtc

SEQ ID NO: 9598 - protein, 976 aa, Homo sapiens [sequence omitted]

SEQ ID NO: 9599 - DNA, 14733 bp, Homo sapiens
  CDS (1)..(14733)
atgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcctttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatacggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttgtggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccgcctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcgggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgtcaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaagggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagagccaatcgagaaactgctggccccagtgcaaatgtcattcaggcatccactcaactacctgctcaagatgtaataaactcttgtggcataactggatcaactccagttctctcaagcttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagcccttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaac

SEQ ID NO: 9600 - protein, 4911 aa, Homo sapiens
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDPLQPGEEVEIAELTTDYNNEMEVEGPEDQMVFSEQAANKDVNGQESTPGIVPDTVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFVVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVSTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKREQENKTLVLSDKHSPQKKSTVTNEVKTEVLSPNSKVESKCETEKNDENKDNVDTPCSQASAHSDLNDGEKTSLHPCDPDLFEKRANRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 9601 - DNA, 570 bp, Homo sapiens
  CDS (1)..(570)
atgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaa

SEQ ID NO: 9602 - protein, 189 aa, Homo sapiens [sequence omitted]

SEQ ID NO: 9603 - DNA, 567 bp, Homo sapiens
  CDS (1)..(567)
atgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaa

SEQ ID NO: 9604 - protein, 188 aa, Homo sapiens [sequence omitted]

SEQ ID NO: 9605 - DNA, 1179 bp, Homo sapiens
  CDS (1)..(1179)
atgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtc

SEQ ID NO: 9606 - protein, 393 aa, Homo sapiens [sequence omitted]

SEQ ID NO: 9607 - DNA, 483 bp, Homo sapiens
  CDS (1)..(483)
atgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaa

SEQ ID NO: 9608 - protein, 160 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 9609 - DNA, 1476 bp, Homo sapiens
  CDS (1)..(1476)
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 9610 - protein, 491 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 9611 - DNA, 1473 bp, Homo sapiens
  CDS (1)..(1473)
atgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataa

SEQ ID NO: 9612 - protein, 490 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 9613 - DNA, 4170 bp, Homo sapiens
  CDS (1)..(4170)
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatca

SEQ ID NO: 9614 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 9615 - DNA, 7647 bp, Homo sapiens
  CDS (1)..(7647)
atgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctgg

SEQ ID NO: 9616 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 9617 - DNA, 1365 bp, Homo sapiens
  CDS (1)..(1365)
ctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaa

SEQ ID NO: 9618 - protein, 454 aa, Homo sapiens
LDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 9619 - DNA, 1095 bp, Homo sapiens
  CDS (1)..(1095)
atggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaa

SEQ ID NO: 9620 - protein, 364 aa, Homo sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 9621 - DNA, 1395 bp, Homo sapiens
  CDS (1)..(1395)
atgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctag

SEQ ID NO: 9622 - protein, 464 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 9623 - DNA, 4275 bp, Homo sapiens
  CDS (1)..(4275)
atgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccaggtgagctcccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctga

SEQ ID NO: 9624 - protein, 1424 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQVSSQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 9625 - DNA, 1815 bp, Homo sapiens
  CDS (1)..(1815)
atgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaac

SEQ ID NO: 9626 - protein, 605 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 9627 - DNA, 720 bp, Homo sapiens
  CDS (1)..(720)
atggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtga

SEQ ID NO: 9628 - protein, 239 aa, Homo sapiens
MATSGRLSFTVRSLLDLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 9629 - DNA, 7665 bp, Homo sapiens
  CDS (1)..(7665)
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaag

SEQ ID NO: 9630 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 9631 - DNA, 570 bp, Homo sapiens
  CDS (1)..(570)
atgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaa

SEQ ID NO: 9632 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 9633 - DNA, 276 bp, Artificial Sequence
  Synthetic dominant negative of Myc
  CDS (1)..(276)
cccgggaccgagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagagacgcaaaagctcatttctgaaatcgacttgttgcggaaacaaaacgaacagttgaaacacaaacttgaacagctacggaactcttgtgcgtaa

SEQ ID NO: 9634 - protein, 91 aa, Artificial Sequence
  Synthetic Construct
PGTENVKRRTHNVLERQRRNELKRSFFALRDQIPELENNEKAPKVVILKKATAYILSVQAETQKLISEIDLLRKQNEQLKHKLEQLRNSCA

SEQ ID NO: 9635 - DNA, 3204 bp, Homo sapiens
  CDS (1)..(3204)
atgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaac

SEQ ID NO: 9636 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 9637 - DNA, 2172 bp, Homo sapiens
  CDS (1)..(2172)
atgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcga

SEQ ID NO: 9638 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 9639 - DNA, 1767 bp, Homo sapiens
  CDS (1)..(1767)
atggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcc

SEQ ID NO: 9640 - protein, 589 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 9641 - DNA, 1779 bp, Homo sapiens
  CDS (1)..(1779)
atgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaagcaagaggaaagggcacgaatatacaaatattaagtattctctagcggaccagacgagtggagatcagagccctctcccgccttgtactccaacgccaccctgtgcagaaatgagagaagacagtgctagagtctatgaaaacgtgggcctgatgcaacagcagaaaagtttcaga

SEQ ID NO: 9642 - protein, 593 aa, Homo sapiens [sequence omitted]

SEQ ID NO: 9643 - DNA, 642 bp, Homo sapiens
  CDS (1)..(642)
atggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctga

SEQ ID NO: 9644 - protein, 213 aa, Homo sapiens
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 9645 - DNA, 633 bp, Homo sapiens
  CDS (1)..(633)
atgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttg

SEQ ID NO: 9646 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 9647 - DNA, 1944 bp, Homo sapiens
  CDS (1)..(1944)
atggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttc

SEQ ID NO: 9648 - protein, 648 aa, Homo sapiens [sequence omitted]

SEQ ID NO: 9649 - DNA, 3141 bp, Homo sapiens
  CDS (1)..(3141)
atgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcagg

SEQ ID NO: 9650 - protein, 1047 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 9651 - DNA, 2784 bp, Homo sapiens
  CDS (1)..(2784)
atgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaa

SEQ ID NO: 9652 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 9653 - DNA, 552 bp, Homo sapiens
  CDS (1)..(552)
atgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatg

SEQ ID NO: 9654 - protein, 184 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 9655 - DNA, 579 bp, Homo sapiens
  CDS (1)..(579)
atggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttg

SEQ ID NO: 9656 - protein, 193 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 9657 - DNA, 612 bp, Homo sapiens
  CDS (1)..(612)
atggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttc

SEQ ID NO: 9658 - protein, 204 aa, Homo sapiens
MAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 9659 - DNA, 1440 bp, Homo sapiens
  CDS (1)..(1440)
atggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctac

SEQ ID NO: 9660 - protein, 480 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 9661 - DNA, 7695 bp, Homo sapiens
  CDS (1)..(7695)
atgaagcagctgcagccgcagccgcctccgaagatgggggatttctacgacccggagcacccgacccctgaagaagaagaaaatgaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtga

SEQ ID NO: 9662 - protein, 2564 aa, Homo sapiens
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 9663 - DNA, 3912 bp, Homo sapiens
  CDS (1)..(3912)
atggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaaaacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatctta

SEQ ID NO: 9664 - protein, 1304 aa, Homo sapiens
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 9665 - DNA, 1275 bp, Homo sapiens
  CDS (1)..(1275)
atgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatga

SEQ ID NO: 9666 - protein, 424 aa, Homo sapiens
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 9667 - DNA, 1401 bp, Homo sapiens
  CDS (1)..(1401)
atgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtca

SEQ ID NO: 9668 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 9669 - DNA, 1656 bp, Homo sapiens
  CDS (1)..(1656)
atggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagac

SEQ ID NO: 9670 - protein, 552 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 9671 - DNA, 1122 bp, Homo sapiens
  CDS (1)..(1122)
atgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcc

SEQ ID NO: 9672 - protein, 374 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 9673 - DNA, 3399 bp, Homo sapiens
  CDS (1)..(3399)
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 9674 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 9675 - DNA, 1701 bp, Homo sapiens
  CDS (1)..(1701)
atgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaa

SEQ ID NO: 9676 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 9677 - DNA, 1182 bp, Homo sapiens
  CDS (1)..(1182)
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactga

SEQ ID NO: 9678 - protein, 393 aa, Homo sapiens [sequence omitted]

SEQ ID NO: 9679 - DNA, 639 bp, Homo sapiens
  CDS (1)..(639)
atgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagat

SEQ ID NO: 9680 - protein, 213 aa, Homo sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 9681 - DNA, 1515 bp, Homo sapiens
  CDS (1)..(1515)
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 9682 - protein, 504 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9683 - DNA, 1482 bp, Homo sapiens
  CDS (1)..(1482)
atgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgac

SEQ ID NO: 9684 - protein, 494 aa, Homo sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 9685 - DNA, 2418 bp, Homo sapiens
  CDS (1)..(2418)
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttag

SEQ ID NO: 9686 - protein, 805 aa, Homo sapiens [sequence omitted]

SEQ ID NO: 9687 - DNA, 3921 bp, Homo sapiens
  CDS (1)..(3921)
atgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctga

SEQ ID NO: 9688 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 9689 - DNA, 2679 bp, Homo sapiens
  CDS (1)..(2679)
atgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctga

SEQ ID NO: 9690 - protein, 892 aa, Homo sapiens
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 9691 - DNA, 2904 bp, Homo sapiens
  CDS (1)..(2904)
atggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatag

SEQ ID NO: 9692 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 9693 - DNA, 2208 bp, Homo sapiens
  CDS (1)..(2208)
atgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaa

SEQ ID NO: 9694 - protein, 735 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 9695 - DNA, 2301 bp, Homo sapiens
  CDS (1)..(2301)
atgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 9696 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 9697 - DNA, 7341 bp, Homo sapiens
  CDS (1)..(7341)
atgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 9698 - protein, 2446 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 9699 - DNA, 2349 bp, Homo sapiens
  CDS (1)..(2349)
atggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataa

SEQ ID NO: 9700 - protein, 782 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 9701 - protein, 60 aa, Artificial Sequence
  Description of Artificial Sequence: Synthetic polypeptide
GRKKRRQRRRPPQGSGSGSMLHDCLMKALKVRGLQPECCAVFRLLHEHKGKKARLDWNTD

SEQ ID NO: 9702 - protein, 52 aa, Artificial Sequence
  Synthetic polypeptide
MSSSSWLLLSLVTAAQSTIEEQAKTFLDKFNHEAEDLFYQSSLASWNYNTNI

SEQ ID NO: 9703 - protein, 59 aa, Artificial Sequence
  Synthetic polypeptide
VLGWPEYQWHPPLPDNYPEGIDLVTDEAEASKFVEEYDRTSQVVWNEYAEANWNYNTNI

SEQ ID NO: 9704 - protein, 59 aa, Artificial Sequence
  Synthetic polypeptide
TTSSQTTTHQATAHQTSAQSPNLVTDEAEASKFVEEYDRTSQVVWNEYAEANWNYNTNI

SEQ ID NO: 9705 - protein, 62 aa, Artificial Sequence
  Synthetic polypeptide
VTVWMAYDTGYTERYMDVPENNQHGYEAGSVALHVEKLPNEPNRLLILHGFLDENVHFFHTN

SEQ ID NO: 9706 - protein, 62 aa, Artificial Sequencd
  Synthetic polypeptide
VTLWIFYDTGYTERYMGHPDQNEQGYYLGSVAMQAEKFPSEPNRLLLLHGFLDENVHFAHTS

SEQ ID NO: 9707 - protein, 48 aa, Artificial Sequence
  Synthetic polypeptide
NVTGYYRVNYDEENWRKIQTQLQRDHSAIPVINRAQIINDAFNLASAH

SEQ ID NO: 9708 - protein, 62 aa, Artificial Sequence
  Synthetic polypeptide
VSSWEYYASVYTERFMGLPTKDDNLEHYKNSTVMARAEYFRNVDYLLIHGTADDNVHFQNSA

SEQ ID NO: 9709 - protein, 62 aa, Artificial Sequence
  Synthetic polypeptide
VSRWEYYDSVYTERYMGLPTPEDNLDHYRNSTVMSRAENFKQVEYLLIHGTADDNVHFQQSA

SEQ ID NO: 9710 - protein, 99 aa, Artificial sequence
  Synthetic polypeptide
GSSIPPYNTEVTETTIVITWTPAPRIGFKLGVRPSQGGEAPREVTSDSGSIVVSGLTPGVEYVYTIQVLRDGDERDAPIVNKVVTPLSPPTNLHLEANP

SEQ ID NO: 9711 - protein, 58 aa, Artificial Sequence
  Synthetic polypeptide
TEENVQNMNNAGDKWSAFLKEQSTLAQMYPLQEIQNLTVKLQLQALQQNGSSVLSEDK

SEQ ID NO: 9712 - protein, 58 aa, Artificial Sequence
  Synthetic polypeptide
TTETSKILLQKNMQIANHTLKYGTQARKFDVNQLQNTTIKRIIKKVQDLERAALPAQE

SEQ ID NO: 9713 - protein, 46 aa, Artificial Sequence
  Synthetic polypeptide
FLVSQLIRAGKPYQLQIYPNERHSIRCPESGEHYEVTLLHFLQEYL

SEQ ID NO: 9714 - protein, 56 aa, Artificial Sequence
  Synthetic polypeptide
ILLSFLVRAGKPYDLQIYPQERHSIRVPESGEHYELHLLHYLQENLGSRIAALKVI

SEQ ID NO: 9715 - protein, 74 aa, Artificial Sequence
  Synthetic polypeptide
KVPVTLALNNTLFLIEERQYMPWEAALSSLSYFKLMFDRSEVYGPMKNYLKKQVTPLFIHFRNNTNNWREIPEN

SEQ ID NO: 9716 - protein, 49 aa, Artificial Sequence
  Synthetic polypeptide
QIAKALVNAQVDFQAMWYSDQNHGLSGLSTNHLYTHMTHFLKQCRSLSD

SEQ ID NO: 9717 - protein, 49 aa, Artificial Sequence
  Synthetic polypeptide
QISKALVDVGVDFQAMWYTDEDHGIASSTAHQHIYTHMSHFIKQCFSLP

SEQ ID NO: 9718 - protein, 38 aa, Artificial Sequence
  Synthetic polypeptide
QSSCTFDNLSPGLEYNVSVYTVKDDKESVPISDTIIPA

SEQ ID NO: 9719 - DNA, 169 bp, Artificial Sequence
  Synthetic sequence
  misc_feature (25)..(144): "n" is A, T, C or G
gtaagcttgatatcggccaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactactgacgggcttgttaaaca

SEQ ID NO: 9720 - DNA, 166 bp, Artificial Sequence
  Synthetic sequence
  misc_feature (25)..(144): "n" is A, T, G or C
ggtgacggttctgggagcggttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgggtccggcagcgaacaaa

What is claimed is:

1. A pharmaceutical composition in unit dose form comprising (a) an isolated RAF proto-oncogene serine/threonine-protein kinase (RAF1) peptide or salt thereof, wherein the isolated RAF1 peptide or salt thereof consists of the amino acid sequence selected from the group consisting of SEQ ID NOs: 3465-3467, 4641-4654, 8340-8403, 9530 and 9531; and (b) a non-naturally occurring pharmaceutically acceptable excipient, diluent, or carrier, wherein the RAF1 peptide or salt thereof kills a cancer cell in an in vitro assay; and/or inhibits cancer cell proliferation as determined by an in vitro assay.

2. The pharmaceutical composition in unit dose form of claim 1, wherein the RAF1 peptide or salt thereof kills the cancer cell in the in vitro assay.

3. The pharmaceutical composition in unit dose form of claim 1, wherein the RAF1 peptide or salt thereof comprises a recombinant peptide.

4. The pharmaceutical composition in unit dose form of claim 1, wherein the RAF1 peptide or salt thereof is a stapled peptide or salt thereof, a stitched peptide or salt thereof, a macrocyclic peptide or salt thereof, or any combination thereof.

5. The pharmaceutical composition in unit dose form of claim 4, wherein the stapled peptide comprises a covalent linkage between two amino acid side-chains of the RAF1 peptide or salt thereof.

6. The pharmaceutical composition in unit dose form of claim 1, wherein the RAF1 peptide or salt thereof inhibits cancer cell proliferation in the in vitro assay.

7. The pharmaceutical composition in unit dose form of claim 1, wherein the RAF1 peptide or salt thereof is operably linked to a protein transduction domain (PTD) selected from the group consisting of SEQ ID NO:9490 to 9505.

* * * * *